US008273557B2

(12) United States Patent
Weiner et al.

(10) Patent No.: US 8,273,557 B2
(45) Date of Patent: Sep. 25, 2012

(54) HYDROLYTIC ENZYME MIXTURES FOR SACCHARIFICATION OF LIGNOCELLULOSIC POLYSACCHARIDES

(75) Inventors: Ronald M. Weiner, Potomac, MD (US); Steven Wayne Hutcheson, Columbia, MD (US)

(73) Assignee: University of Maryland, College Park, MD (US)

( * ) Notice: Subject to any disclaimer, the term of this patent is extended or adjusted under 35 U.S.C. 154(b) by 411 days.

(21) Appl. No.: 11/519,104

(22) Filed: Sep. 12, 2006

(65) Prior Publication Data
US 2007/0292929 A1 Dec. 20, 2007

Related U.S. Application Data

(63) Continuation-in-part of application No. 11/121,154, filed on May 4, 2005, now Pat. No. 7,365,180.

(60) Provisional application No. 60/567,971, filed on May 4, 2004.

(51) Int. Cl.
*C12P 7/02* (2006.01)
*C12P 7/06* (2006.01)
*C12N 9/00* (2006.01)
*C12N 9/42* (2006.01)
*C07H 21/04* (2006.01)

(52) U.S. Cl. ........ 435/155; 435/161; 435/183; 435/209; 536/23.2

(58) Field of Classification Search ........................ None
See application file for complete search history.

(56) References Cited

U.S. PATENT DOCUMENTS
2006/0105914 A1  5/2006  Taylor et al.

OTHER PUBLICATIONS

Whisstock et al. Q Rev Biophys. Aug. 2003;36(3):307-40.*
Liu et al. Amino Acids. Oct. 2008;35(3):627-50. Epub Apr. 18, 2008.*
Thornton et al. Nat Struct Biol. Nov. 2000;7 Suppl:991-4.*
Dien et al. Appl Biochem Biotechnol. Spring 2000;84-86:181-96.*
Ensor et al. J. Ind. Microbiol. Biotechnol. 1999; 23: 123-126.*
Taylor et al. J Bacteriol. Jun. 2006;188(11):3849-61.*
Bhat M K: "Cellulases and related enzymes in biotechnology" Biotechnology Advances, Elsevier Publishing, Barking, GB, vol. 18, No. 5, Aug. 1, 2000, pp. 355-383, XP004211815.
Taylor Larry E II et al: "Complete cellulase system in the marine bacterium *Saccharophagus degradans* strain 2-40(T)" Journal of Bacteriology, vol. 188, No. 11, pp. 3849-3861, Jun. 1, 2006, XP002525799.
Gray, K.A., et al. (2006) "Bioethanol." Curr. Opin. Chem. Biol., 10(2):141-146.
Katahira, S., et al. (2006) "Ethanol fermentation from lignocellulosic hydrolysate by a recombinant xylose- and cellooligosaccharide-assimilating yeast strain", Appl. Microbiol. Biotechnol., 72(6):1136-1143.
Patel-Predd, P., et al. (2006) "Overcoming the hurdles to producing ethanol from cellulose", Environ. Sci. Technol., 40(13):4052-4053.
Zhang, Y.-H. Percival, et al. (2006) "Outlook for cellulase improvement: Screening and selection strategies", Biotechnol. Adv., 24(5):452-481.
Everett et al. Pendred syndrome is caused by mutations on a putative sulphate transporter gene (PDS). Nature Genetics 17: 411-422. 1997. Accession No. ZP_00066178.1 [online]. [Retrieved on May 9, 2007] Retrieved from: http://www.ncbi.nim.nih.gov/protein/ZP_00066178.1.
Scott et al. The Pendred syndrome gene encodes a chloride-iodide transport protein. Nature Genetics 21: 440-443. 1999.
Andrykovitch, G. and I. Marx (1988). "Isolation of a new polysaccharide-digesting bacterium from a salt marsh." Applied and Environmental Microbiology 54: 3-4.
Coutinho, P.M. And B. Henrissatt (1999). "The modular structure of cellulases and other carbohydrate-active enzymes: an integrated database approach." Genetics, biochemistry and ecology of cellulose degradation. T. Kimura. Tokyo, Uni Publishers Co: 15-23.
Gonzalez, J. and R. M. Weiner (2000). "Phylogenetic characterization of marine bacterium strain 2-40, a degrader of complex polysaccharides." International journal of systematic evolution microbiology 50: 831-834.
Henrissat, B. and A. Bairoch (1993). "New families in the classification of glycosyl hydrolases based on amino acid sequence similarities." Biochem J 293 (Pt 3): 781-8.
Henrissat, B., T. T. Teeri, et al. (1998). "A scheme for designating enzymes that hydrolyse the polysaccharides in the cell walls of plants." FEBS Lett 425(2): 352-4.
Warren, R. A. (1996). "Microbial hydrolysis of polysaccharides." Annu Rev Microbiol 50: 183-212.
Watson, B.J., H. Zhang, S.W. Hutcheson, "Biochemical Properties and Characterization of Saccharophagus degradans 2-40 Cel5H." Department of Materials Science and Engineering; Department of Cell Biology and Molecular Genetics, University of Maryland College Park, MD 20742, Aug. 3, 2007.
Whitehead, L.A., Stosz S.K., Weiner, R.M. "Characterization of the agarase system of a multiple carbohydrate degrading marine bacterium." Cytobios. 2001: 106 Suppl 1:99-117. PMID: 11534834 [PubMed—indexed for MEDLINE].
Wood, T.M., K.M. Bhat (1998). "Methods for Measuring Cellulase Activities." Methods in Enzymology, vol. 160, pp. 87-112. Academic Press Inc.

* cited by examiner

*Primary Examiner* — Christian Fronda
(74) *Attorney, Agent, or Firm* — Lathrop & Gage LLP; Sean M. Coughlin, Esq.

(57) ABSTRACT

The present invention relates to cell wall degradative systems, in particular to systems containing enzymes that bind to and/or depolymerize cellulose. These systems have a number of applications. Some embodiments relate to a method of producing ethanol using the cell wall degradative systems of the present invention.

12 Claims, 11 Drawing Sheets

Nonreducing end group — Cellulose — Reducing end group

SDS-PAGE and Zymogram analysis of 2-40 culture supernatants.

Predicted cellulases of *M. degradans* 2-40. Cellulase depolymerases and accessories as predicted by CAZyme analysis and sequence-based functional predictions as described in the text.

| Name | MS | amino acids | MW | Predicted function | Modules | Refseq accession |
|---|---|---|---|---|---|---|
| cel5A | | 1,167 | 127.2 | endo 1,4-glucanase | GH5/CBM6/CBM6/CBM6/GH5 | ZP_00067013.1 |
| cel5B | | 566 | 60.8 | endo 1,4-glucanase | LPB/PSL(47)/CBM6/GH5 | ZP_00064853.1 |
| cel5C | | 451 | 49.1 | endo 1,4-glucanase | LPB/PSL(47)/GH5 | ZP_00067454.1 |
| cel5D | | 621 | 65.9 | endo 1,4-glucanase | CBM2/PSL(58)/CBM10/PSL(36)GH5 | ZP_00064986.1 |
| cel5E | | 673 | 72.6 | endo 1,4-glucanase | CBM6/CBM6/GH5 | ZP_00066079.1 |
| cel5F | | 365 | 42.0 | endo 1,4-glucanase | GH5 | ZP_00066536.1 |
| cel5G | | 638 | 67.9 | endo 1,4-glucanase | GH5/PSL(21)/CBM6/PSL(32)/Y95 | ZP_00066178.1 |
| cel5H | av | 630 | 66.9 | endo 1,4-glucanase | GH5/PSL(32)/CBM6/EPR(16) | ZP_00068260.1 |
| cel5I | av | 725 | 77.2 | endo 1,4-glucanase | CBM2/PSL(33)/CBM10/PSL(58)/GH5 | ZP_00067367.1 |
| cel5J | | 610 | 65.2 | endo 1,4-glucanase | GH5/CBM6/CBM6 | ZP_00064857.1 |
| cel6A | | 791 | 81.9 | non-reducing end cellobiohydrolase | CBM2/PSL(43)/CBM2/PSL(85)/GH6 | ZP_00064659.1 |
| cel9A | | 578 | 62.7 | endo-1,4-glucanase | GH9 | ZP_00065765.1 |
| cel9B | av | 867 | 89.5 | endo-1,4-glucanase | GH9/PSL(54)/CBM10/PSL(50)/CBM2 | ZP_00065776.1 |
| ced3A | av, cm, xn | 1,072 | 116.0 | cellodextrinase | LPB/GH3/PLP | ZP_00064860.1 |
| ced3B | xn | 862 | 92.9 | cellodextrinase | LPB/GH3 | ZP_00068210.1 |
| bgl1A | | 461 | 52.8 | cellobiase | †GH1 | ZP_00067238.1 |
| bgl1B | | 444 | 49.8 | cellobiase | †GH1 | ZP_00066838.1 |
| bgl3C | av, cm, xn | 866 | 95.4 | β-glucosidase | LPB/GH3/UNK(511) | ZP_00066570.1 |
| cep94A | | 811 | 91.7 | cellobiose phosphorylase | †GH94 | ZP_00067911.1 |
| cep94B | cm | 788 | 88.7 | cellodextrin phosphorylase | †GH94 | ZP_00068287.1 |

FIG. 4

Predicted xylanases, xylosidases and related accessories.

| Name | MS | amino acids | MW | Predicted function | Modules | Refseq accession |
|---|---|---|---|---|---|---|
| xyn10A | | 574 | 61.7 | β-1,4-xylanase | GH10/PSR(29)/Y94/PSL(21)/CBM5 | ZP_00066395.1 |
| xyn10B | | 619 | 65.0 | β-1,4-xylanase | CBM2/PSL(42)/CBM10/PSL(48)/GH10 | ZP_00066073.1 |
| xyn10C | | 374 | 42.3 | β-1,4-xylanase | GH10 | ZP_00064983.1 |
| xyl/arb43G-xyn10D | | 1,186 | 129.6 | β-xylosidase/α-L-arabino furanosidase/β-1,4-xylanase | GH43/CBM6/Y94/PSL(24)/CBM2/PSL(22)/CBM22/GH10 | ZP_00067229.1 |
| xyn10E | xn | 670 | 75.2 | β-1,4-xylanase | LPB/EPR(47)/GH10 | ZP_00067456.1 |
| xyn11A | | 275 | 30.4 | β-1,4-xylanase | GH11 | ZP_00066908.1 |
| xyn11B-axe4A | | 767 | 80.8 | bifunctional β-1,4-xylanase/acetylxylanesterase | GH11/PSL(10)/PSL(19)/CE4/CBM10 | ZP_00067071.1 |
| axe2A | | 360 | 40.9 | acetylxylan esterase | CE2 | ZP_00064735.1 |
| xyl31A | xn | 973 | 110.2 | α-xylosidase for xyloglucans | LPB/GH31 | ZP_00064863.1 |
| xyl3A | av, cm, xn | 893 | 97.6 | β-xylosidase | LPB/GH3 | ZP_00067626.1 |
| xyl43L | | 317 | 36.1 | α-xylosidase | GH43 | ZP_00067829.1 |
| xyl/arb43H | | 577 | 63.8 | bifunctional β-xylosidase/α-L-arabinofuranosidase | LPB/GH43 | ZP_00065724.1 |
| xyl/arb43I | | 566 | 62.6 | bifunctional β-xylosidase/α-L-arabinofuranosidase | LPB/GH43 | ZP_00066469.1 |
| xyl/arb43J | | 317 | 35.1 | bifunctional β-xylosidase/α-L-arabinofuranosidase | LPB/GH43 | ZP_00066992.1 |
| xyl/arb43K | | 385 | 42.6 | bifunctional β-xylosidase/α-L-arabinofuranosidase | LPB/GH43 | ZP_00315109.1 |
| agu67A | | 738 | 82.0 | α-1,2-glucuronidase | GH67 | ZP_00315039.1 |

FIG. 5

Predicted pectinases and accessories.

| Name | amino acids | MW | Predicted function | Modules | Refseq accession |
|---|---|---|---|---|---|
| pel1A | 1,316 | 136.4 | pectate lyase | PL1/PSL(35)/PSL(29)/FN3/PSL(65)/PL1 | ZP_00067832.1 |
| pel1B | 427 | 46.1 | pectate lyase | PL1 | ZP_00067840.1 |
| pel1C | 769 | 78.9 | pectate lyase | PL1/PSL(33)/PSL(23)/FN3 | ZP_00067834.1 |
| pel1D | 594 | 63.3 | pectate lyase | LPB/EPR(24)/PL1 | ZP_00067182.1 |
| pel1E | 425 | 45.4 | pectate lyase | LPB/PL1 | ZP_00064693.1 |
| pel1F | 772 | 81.5 | polysaccharide lyase (pectate?) | CBM2/PSL(45)/PSL(31)/PL1 | ZP_00064697.1 |
| pel3A | 511 | 52.3 | pectate lyase | CBM2/PSL(30)/PSL(20)/PL3 | ZP_00064694.1 |
| pel3B | 452 | 46.1 | pectate lyase | PSL(24)/FN3/PSL(20)/PL3 | ZP_00065735.1 |
| pel3C | 424 | 42.9 | pectate lyase | PSL(19)/FN3/PSL(18)/PL3 | ZP_00067017.1 |
| pel3D | 392 | 41.6 | pectate lyase | CBM13/PL3 | ZP_00067887.1 |
| pel9A | 733 | 75.6 | pectate lyase | PSL(47)/FN3/FN3/PL9 | ZP_00066061.1 |
| pel10A | 700 | 73.3 | pectate lyase | CBM2/PSL(54)/PSL(28)/PL10 | ZP_00068232.1 |
| pel10B | 574 | 60.8 | pectate lyase | LPB/PSL(46)/PL10 | ZP_00066059.1 |
| pgl28A | 463 | 50.9 | polygalacturonanase | LPB/GH28 | ZP_00067822.1 |
| pes8A | 1,081 | 115.1 | pectin methylesterase | LPB/EPR(23)/CE8 | ZP_00067183.1 |
| pes8B | 389 | 42.4 | pectin methylesterase | LPB/CE8 | ZP_00067831.1 |
| rgl11A | 914 | 97.6 | rhamnogalacturonan lyase | PL11/PSL(33)/CBM2 | ZP_00066475.1 |

FIG. 6

Predicted arabinanases and arabinogalactanases of 2-40. The bifunctional xylosidase/arabinanases in table 2 are also expected to function as accessories to these enzymes

| Name | amino acids | MW | Predicted function | Modules | Refseq accession |
|---|---|---|---|---|---|
| arb43A | 789 | 85.0 | endo-1,5-a-L-arabinanase | CBM13/GH43 | ZP_00066674.1 |
| arb43B | 362 | 40.7 | exo-1,5-a-L-arabinofuranosidase | LPB/GH43 | ZP_00066990.1 |
| arb43C | 314 | 35.9 | exo-1,5-a-L-arabinofuranosidase | †GH43 | ZP_00066981.1 |
| arb43D | 472 | 51.1 | endo-1,5-a-L-arabinanase | CBM13/GH43 | ZP_00068164.1 |
| arb43E | 346 | 38.6 | endo-1,5-a-L-arabinanase | LPB/GH43 | ZP_00066989.1 |
| arb43F | 607 | 67.2 | exo-1,5-a-L-arabinofuranosidase | GH43 | ZP_00066994.1 |
| arb51A | 534 | 59.4 | exo-1,5-a-L-arabinofuranosidase | GH51 | ZP_00315975.1 |
| arg53A | 397 | 44.5 | arabinogalactanase | GH53 | ZP_00068112.1 |
| arg53B | 476 | 52.6 | arabinogalactanase | GH53/CBM13 | ZP_00065874.1 |
| arg53C | 650 | 71.1 | arabinogalactanase | GH53 | ZP_00068237.1 |

FIG. 7

Predicted mannanases of 2-40.

| Name | MS | amino acids | MW | Predicted function | Modules | Refseq accession |
|---|---|---|---|---|---|---|
| man26A | | 506 | 54.9 | mannanase | LPB/PSL(52)/CBM10/GH26 | ZP_00065857.1 |
| man5N | | 561 | 57.6 | mannanase | GH5/PSL(32)/CBM10/PSR(44)/CBM2 | ZP_00065570.1 |
| man5O | | 507 | 52.6 | mannanase | GH5/PSL(23)/CBM10/CBM10 | ZP_00065784.1 |
| man5P | cm | 457 | 50.9 | mannanase | GH5 | ZP_00065642.1 |
| man5Q | ag | 850 | 92.3 | mannanase | LQAC/GH5 | ZP_00064894.1 |
| agl27A | | 408 | 46.5 | α-galactosidase | GH27 | ZP_00066516.1 |

FIG. 8

Predicted laminarinases of 2-40.

| Name | amino acids | MW | Predicted function | Modules | Refseq accession |
|---|---|---|---|---|---|
| lam16A | 1,707 | 163.3 | β-1,3-glucanase | GH16/CBM6/CBM6/TSP3/TSP3/TSP3/TSP3/COG3488 | ZP_00066839.1 |
| lam16B | 1,441 | 158.6 | β-1,3-glucanase | GH16/CBM6/CBM6/EPR(56)/CBM32/CBM32 | ZP_00066081.1 |
| lam16C | 1,184 | 129.1 | β-1,3-glucanase | GH16/CBM4/CBM32/CBM32 | ZP_00066789.1 |
| lam16D | 722 | 77.7 | β-1,3-glucanase | GH16/CBM32/PSR(48)/TMR | ZP_00067027.1 |
| lam16E | 569 | 61.4 | β-1,3-glucanase | CBM6/CBM6/GH16 | ZP_00065780.1 |
| lam16F | 742 | 80.2 | β-1,3-glucanase | LPB/GH16 | ZP_00066288.1 |
| lam16G | 877 | 94.2 | catalytic residues missing | LPB/GH16/CBM6/CBM6 | ZP_00068290.1 |
| lam81A | 1,238 | 133.1 | β-1,3-glucanase | LPB/CADG/GH81/FN3/FN3 | ZP_00068322.1 |

FIG. 9

Selected carbohydrate-binding module (CBM) proteins. Function is unknown for proteins containing CBM domains but lacking another well-characterized domain.

| Name | MS | amino acids | MW | Predicted function | Modules | Refseq accession |
|---|---|---|---|---|---|---|
| cbm2A | | 354 | 37.9 | cbm2a binds crystalline cellulose | CBM2/EPR(48)/UNK(174) | ZP_00067766.1 |
| cbm2B | av | 1,042 | 112.1 | cbm2a | CBM2/UNK(914) | ZP_00067765.1 |
| cbm2C | xn | 933 | 97.5 | cbm2a | CBM2/PSL(58)/Y94/PSL(25)/UNK(577) | ZP_00066396.1 |
| cbm2D-cbm10A | | 558 | 56.3 | cbm2a | CBM2/PSL(43)/CBM10/PSL(101)/UNK(231) | ZP_00065777.1 |
| cbm2E | | 781 | 85.0 | cbm2a | CBM2/PSL(18)/PSL(18)/UNK(471) | ZP_00065695.1 |
| cbm2F | | 787 | 84.8 | cbm2a | CBM2/PSL(33)/PSL(17)/UNK(544) | ZP_00066068.1 |
| cbm6A | | 681 | 72.5 | cbm6 binds glycan chains | LPB/PSL(28)/CBM6/UNK(476) | ZP_00068207.1 |
| cbm6B | | 630 | 67.2 | cbm6 | CBM6/CBM6/UNK(217) | ZP_00066418.1 |
| cbm6C | | 550 | 59.8 | cbm6 | CBM6/UNK(216) | ZP_00065386.1 |
| cbm6D | | 500 | 54.6 | cbm6 | CBM6/UNK(262) | ZP_00068152.1 |
| cbm6E | | 473 | 53.0 | cbm6 | LPB/UNK(~300)/CBM6 | ZP_00066788.1 |
| cbm6F | | 465 | 50.4 | cbm6 | UNK(~300)/CBM6 | ZP_00065421.1 |
| cbm6G-cbm16B | | 1,024 | 111.4 | cbm16; cbm16 unknown | CBM6/CBM16/UNK(704) | ZP_00066336.1 |
| cbm6H-cbm32F | | 912 | 97.5 | cbm6; cbm32 binds monos/oligos (1-3) | UNK(~500)CBM6/CBM32 | ZP_00066663.1 |
| cbm16A-cbm32E | | 552 | 58456 | cbm16; cbm32 | CBM16/PTR/CBM32/PTR/UNK(232) | ZP_00068306.1 |
| cbm32A | xn | 1,028 | 111.9 | cbm32; COG3488 thiol-oxidoreductase | CBM32/CBM32/UNK(251)/COG3488 | ZP_00065611.1 |
| cbm32B | | 557 | 59.5 | cbm32 | UNK(~100)/CBM32/CBM32/CBM32 | ZP_00066007.1 |
| cbm32C | | 674 | 73.6 | Zn-protease; Cbm32; FN3 unknown | ZDP/CBM32/FN3/FN3/CBM32 | ZP_00067813.1 |
| cbm32D | | 818 | 88.8 | Cbm32; FCL eel fucolectin-like domain | CBM32/FCL/UNK(521) | ZP_00065873.1 |

FIG. 10

Recombinant proteins and comparison of predicted vs. observed molecular weights. Proteins cloned and expressed for functional characterization as described in text.

| Name | amino acids | MW (kDa) | PAGE MW | Predicted function | Modules |
|---|---|---|---|---|---|
| rLam16A | 1,738 | 186.9 | ~240 | β-1,3-glucanase | GH16/CBM6/CBM6/TSP3/TSP3/TSP3/TSP3/COG3488 |
| rLam16D | 761 | 82.2 | ~90 | β-1,3-glucanase | GH16/CBM32/PSL(48)/TMR |
| rCel5A | 1,117 | 121.9 | ~130 | β-1,4-endoglucanase | GH5/CBM6/CBM6/CBM6/GH5 |
| rGly3D | 1,591 | 174.3 | ~180 | β-glycosidase | CBM32/CBM32/CBM32/GH3/CBM32 |
| rGly5K | 892 | 97.8 | ~115 | (1,3 or 1,4) endoglucanase | GH5/CBM6/CBM6/CBM13 |
| rGly5M | 885 | 96.5 | ~125 | (1,3 or 1,4) endoglucanase | LPB/EPR(34)/GH5/FN3/CBM6 |
| rGly9C | 663 | 72.9 | ~70 | glycanase <25% ID to cellulases | GH9 |
| rGly43M | 1,198 | 130.3 | ~135 | β-glycosidase | LPB/GH43/LGL/LGL |
| rCbm2A | 340 | 36.6 | ~45 | binds crystalline cellulose | CBM2/EPR(48)/UNKNOWN(174) |
| rCbm2B | 1,031 | 110.9 | ~125 | binds crystalline cellulose | CBM2/UNKNOWN(914) |
| rCbm2C | 950 | 99.3 | ~140 | binds crystalline cellulose | CBM2/PSL(58)/Y94/PSL(25)/UNKNOWN(577) |
| rCbm2D-cbm10A | 578 | 58.7 | 15-25† | binds crystalline cellulose | CBM2/PSL(43)/CBM10/PSL(101)/UNKNOWN(231) |

HYDROLYTIC ENZYME MIXTURES FOR SACCHARIFICATION OF LIGNOCELLULOSIC POLYSACCHARIDES

CROSS-REFERENCE TO RELATED APPLICATIONS

This application is a continuation-in-part of U.S. application Ser. No. 11/121,154 filed May 4, 2005 now U.S. Pat. No. 7,365,180 and claims priority to U.S. Provisional Application No. 60/567,971, filed May 4, 2004, the contents of which are incorporated herein, in their entirety, by reference.

STATEMENT REGARDING FEDERALLY SPONSORED RESEARCH OR DEVELOPMENT

This invention was made with government support under Contract Number SA7528051E awarded by the National Oceanic and Atmospheric Administration (NOM) and Contract Number DEB0109869 awarded by the National Science Foundation (NSF). The government has certain rights in the invention.

SEQUENCE LISTING

The instant application contains a "lengthy" Sequence Listing which has been submitted via CD-R in lieu of a printed paper copy, and is hereby incorporated by reference in its entirety. Said CD-R, recorded on Aug. 15, 2007, are labeled CRF, "Copy 1" and "Copy 2", respectively, and each contains only one identical 826 Kb file (18172124.txt).

The present application contains a lengthy Sequence Listing, which has been submitted via triplicate CD-R in lieu of a printed paper copy, and is hereby incorporated by reference in its entirety. The CD-R5, recorded on Sep. 14, 2005 in related U.S. application Ser. No. 11/121,154 filed May 4, 2005, are labeled "CRF", "Copy 1," and "Copy 2," respectively, and each contains only one identical 828 KB file (18172121.APP).

BACKGROUND OF THE INVENTION

1. Field of the Invention

The invention is generally directed to degradative enzymes and systems. In particular, the present invention is directed to plant cell wall degrading enzymes and associated proteins found in *Microbulbifer degradans*, systems containing such enzymes and/or proteins, and methods of using the systems to obtain ethanol.

2. Background of the Invention

Cellulases and related enzymes have been utilized in food, beer, wine, animal feeds, textile production and laundering, pulp and paper industry, and agricultural industries. Various such uses are described in the paper "Cellulases and related enzymes in biotechnology" by M. K. Bhat (Biotechnical Advances 18 (2000) 355-383), the subject matter of which is hereby incorporated by reference in its entirety.

The cell walls of plants are composed of a heterogenous mixture of complex polysaccharides that interact through covalent and noncovalent means. Complex polysaccharides of higher plant cell walls include, for example, cellulose ($\beta$-1,4glucan) which generally makes up 35-50% of carbon found in cell wall components. Cellulose polymers self associate through hydrogen bonding, van der Waals interactions and hydrophobic interactions to form semi-crystalline cellulose microfibrils. These microfibrils also include noncrystalline regions, generally known as amorphous cellulose. The cellulose microfibrils are embedded in a matrix formed of hemicelluloses (including, e.g., xylans, arabinans, and mannans), pectins (e.g., galacturonans and galactans), and various other $\beta$-1,3 and $\beta$-1,4 glucans. These matrix polymers are often substituted with, for example, arabinose, galactose and/or xylose residues to yield highly complex arabinoxylans, arabinogalactans, galactomannans, and xyloglucans. The hemicellulose matrix is, in turn, surrounded by polyphenolic lignin.

The complexity of the matrix makes it difficult to degrade by microorganisms as lignin and hemicellulose components must be degraded before enzymes can act on the core cellulose microfibrils. Ordinarily, a consortium of different microorganisms is required to degrade cell wall polymers to release the constituent monosaccharides. For saccharification of plant cell walls, the lignin must be permeabilized and hemicellulose removed to allow cellulose-degrading enzymes to act on their substrate. For industrial saccharification of cell walls, large amounts of primarily fungal cellulases are added to processed feedstock that has been treated with dilute sulfuric acid at high temperature and pressure to permeabilize the lignin and partially saccharify the hemicellulose constituents.

*Saccharophagus degradans* strain 2-40 (herein referred to as "*S. degradans* 2-40" or "2-40") is a representative of an emerging group of marine bacteria that degrade complex polysaccharides (CP). *S. degradans* has been deposited at the American Type Culture Collection and bears accession number ATCC 43961. *S. degradans* 2-40, formerly known and referred to synonymously herein as *Microbulbifer degradans* strain 2-40 ("*M. degradans* 2-40"), is a marine □-proteobacterium that was isolated from decaying *Sparina alterniflora*, a salt marsh cord grass in the Chesapeake Bay watershed. Consistent with its isolation from decaying plant matter, *S. degradans* strain 2-40 is able to degrade many complex polysaccharides, including cellulose, pectin, xylan, and chitin, which are common components of the cell walls of higher plants. *S. degradans* strain 2-40 is also able to depolymerize algal cell wall components, such as agar, agarose, and laminarin, as well as protein, starch, pullulan, and alginic acid. In addition to degrading this plethora of polymers, *S. degradans* strain 2-40 can utilize each of the polysaccharides as the sole carbon source. Therefore, *S. degradans* strain 2-40 is not only an excellent model of microbial degradation of insoluble complex polysaccharides (ICPs) but can also be used as a paradigm for complete metabolism of these ICPs. ICPs are polymerized saccharides that are used for form and structure in animals and plants. They are insoluble in water and therefore are difficult to break down.

*Microbulbifer degradans* strain 2-40 requires at least 1% sea salts for growth and will tolerate salt concentrations as high as 10%. It is a highly pleomorphic, Gram-negative bacterium that is aerobic, generally rod-shaped, and motile by means of a single polar flagellum. Previous work has determined that 2-40 can degrade at least 10 different carbohydrate polymers (CP), including agar, chitin, alginic acid, carboxymethylcellulose (CMC), $\beta$-glucan, laminarin, pectin, pullulan, starch and xylan (Ensor, Stotz et al. 1999). In addition, it has been shown to synthesize a true tyrosinase (Kelley, Coyne et al. 1990). 16S rDNA analysis shows that 2-40 is a member of the gamma-subclass of the phylum *Proteobacteria*, related to *Microbulbifer hydrolyticus* (Gonzalez and Weiner 2000) and to *Teridinibacter* sp., (Distel, Morrill et al. 2002) cellulolytic nitrogen-fixing bacteria that are symbionts of shipworms.

The agarase, chitinase and alginase systems have been generally characterized. Zymogram activity gels indicate that all three systems are comprised of multiple depolymerases and multiple lines of evidence suggest that at least some of these depolymerases are attached to the cell surface (Stotz 1994; Whitehead 1997; Chakravorty 1998). Activity assays reveal that the majority of 2-40 enzyme activity resides with the cell fraction during logarithmic growth on CP, while in later growth phases the bulk of the activity is found in the supernatant and cell-bound activity decreases dramatically (Stotz 1994). Growth on CP is also accompanied by dramatic alterations in cell morphology. Glucose-grown cultures of 2-40 are relatively uniform in cell size and shape, with generally smooth and featureless cell surfaces. However, when grown on agarose, alginate, or chitin, 2-40 cells exhibit novel surface structures and features.

These exo- and extra-cellular structures (ES) include small protuberances, larger bleb-like structures that appear to be released from the cell, fine fimbrae or pili, and a network of fibril-like appendages which may be tubules of some kind. Immunoelectron microscopy has shown that agarases, alginases and/or chitinases are localized in at least some types of 2-40 ES. The surface topology and pattern of immunolocalization of 2-40 enzymes to surface protuberances are very similar to what is seen with cellulolytic members of the genus *Clostridium*.

The oldest methods studied to convert lignocellulosic materials to saccharides are based on acid hydrolysis (see, e.g., review by Grethlein, Chemical Breakdown Of Cellulosic Materials, J. APPL. CHEM. BIOTECHNOL. 28:296-308 (1978)). This process can involve the use of concentrated or dilute acids. For example, U.S. Pat. Nos. 5,221,537 and 5,536,325, incorporated by reference herein in their entireties, describe a two-step process for the acid hydrolysis of lignocellulosic material to glucose. These processes have numerous disadvantages including, for example, recovery of the acid, the specialized materials of construction required, the need to minimize water in the system, and the high production of degradation products which can inhibit the fermentation to ethanol.

To overcome the problems of the acid hydrolysis process, cellulose conversion processes are being developed using enzymatic hydrolysis. See, for example, U.S. Pat. No. 5,916,780, incorporated by reference herein in its entirety, which discloses enzymatic hydrolysis with a pre-treatment step to break down the integrity of the fiber structure and make the cellulose more accessible to attack by cellulase enzymes in the treatment phase.

U.S. Pat. No. 6,333,181, incorporated by reference herein in its entirety, discloses production of ethanol from lignocellulosic material by treatment of a mixture of lignocellulose, cellulose, and an ethanologenic microorganism with ultrasound.

There exists a need to identify enzyme systems that use cellulose as a substrate, express the genes encoding the proteins using suitable vectors, identify and isolate the amino acid products (enzymes and non-enzymatic products), and use these products as well as organisms containing these genes for purposes, such as the production of ethanol and uses described in the Bhat paper. There is also a need in the art of using lignocellulosic materials for production of ethanol, to develop more effective treatment methods that result in greater yields of ethanol.

SUMMARY OF THE INVENTION

One aspect of the present invention is directed to systems of plant wall active carbohydrases and related proteins.

A further aspect of the invention is directed to a method for the degradation of substances comprising cellulose. The method involves contacting the cellulose containing substances with one or more compounds obtained from *Saccharophagus degradans* strain 2-40.

Another aspect of the present invention is directed to groups of enzymes that catalyze reactions involving cellulose.

Another aspect of the present invention is directed to polynucleotides that encode polypeptides with cellulose degrading or cellulose binding activity.

A further aspect of the invention is directed to chimeric genes and vectors comprising genes that encode polypeptides with cellulose depolymerase activity.

A further aspect of the invention is directed to a method for the identification of a nucleotide sequence encoding a polypeptide comprising any one of the following activities from *S. degradans*: cellulose depolymerase, or cellulose binding. An *S. degradans* genomic library can be constructed in *E. coli* and screened for the desired activity. Transformed *E. coli* cells with specific activity are created and isolated.

Another aspect of the invention is directed to a method for producing ethanol from lignocellulosic material, comprising treating lignocellulosic material with an effective saccharifying amount of one or more compounds listed in FIGS. 4-11 to obtain saccharides and converting the saccharides to produce ethanol. Conversion of sugars to ethanol and recovery may be accomplished by, but are not limited to, any of the well-established methods known to those of skill in the art. For example, through the use of an ethanologenic microorganism, such as *Zymomonas, Erwinia, Klebsiella, Xanthomonas*, and *Escherichia*, preferably *Escherichia coli* KO11 and *Klebsiella oxytoca* P2.

A further aspect of the invention is directed to a method for producing ethanol from lignocellulosic material, comprising contacting lignocellulosic material with a microorganism expressing an effective saccharifying amount of one or more compounds listed in FIGS. 4-11 to obtain saccharides and converting the saccharides to produce ethanol.

A further aspect of the invention is directed to a method for producing ethanol from lignocellulosic material, comprising contacting lignocellulosic material with an ethanologenic microorganism expressing an effective saccharifying amount of one or more compounds listed in FIGS. 4-11 to produce ethanol. Such an ethanologenic microorganism expresses an effective amount of one or more compounds listed in FIGS. 4-11 to saccharify the lignocellulosic material and an effective amount of one or more enzymes or enzyme systems which, in turn, catalyze (individually or in concert) the conversion of the saccharides to ethanol.

Further aspects of the invention are directed to utilization of the cellulose degrading substances in food, beer, wine, animal feeds, textile production and laundering, pulp and paper industry, and agricultural industries.

The present invention is advantageous in that saccharification of plant cell walls and ethanol production processes including saccharification may be obtained without permeabilizing lignin and/or removing or partially saccharifying the hemicellulose or hemicellulose constituents before the cellulose-degrading enzymes can act on their substrate. The present invention also allows for saccharification and ethanol production processes including saccharification without or with a reduced amount of fungal cellulases, acids (e.g., sulfuric acid), high temperatures, and high pressures in the saccharification process.

Other aspects, features, and advantages of the invention will become apparent from the following detailed descrip-

BRIEF DESCRIPTION OF THE FIGURES

FIG. 3A is Avicel grown, where Lane 1 is 8% SDS-PAGE gel stained with Coomassie blue, Lane 2 is PAGE gel containing 0.1% CMC stained with 1% Congo Red and destained with 1 M NaCl, and Lane 3 is 8% SDS-PAGE gel incubated in 1 mM MU-cellobiose view by UV trans-illumination.

FIG. 3B is Xylan grown, where Lane 1 is Coomassie blue stained SDS-PAGE gel, and Lane 2 is 8% SDS-PAGE gel with 0.2% xylan incorporated, stained with Congo red, and destained with 1 M NaCl;

FIG. 4 lists the predicted cellulases of S. degradans 2-40 (the sequences from FIGS. 4-10 are disclosed as SEQ ID NOs 1-214, respectively in order of appearance in the appendix). The protein was identified by tandem mass spectrometry in supernatant concentrates. The molecular weight (MW) and amino acid count was calculated using the protParam (protein parameters) tool at the Expasy website (http://us.expasy.org/tools/) based on the DOE/JGI (Department of Entergy's Joint Genome Initiative) gene model amino acid sequence translations and includes any predicted signal peptide. Predicted function and GH, GT, and CBM modules were determined according to CAZy ModO (Carbohydrase Active EnZyme Modular Organization) analysis by B. Henrissat, AFMB-CRNS. Reference sequence (Refseq) accession numbers of gene amino acid sequences are from the Entrez protein database (http://www.ncbi.nlm.nih.gov/pubmed). Abbreviations in the "name" column include: cel=cellulose, ced=cellodextrinase, bql=β-glucosidase, and cep=cellobiose/cellodextrin phosphorylase. Growth substrates in the "MS" column include: av=avicel, ag=agarose, at=alginate, cm=CMC, and xn=xylan. Daggers (†) in the "Modules" column indicate lack of a secretion signal sequence and nonstandard abbreviations in the "Modules" column include: LPB=lipobox motif, PSL=polyserine linker, EPR=gluatmic acid=praline rich region, and PLP=phospholipase-like domain. The number in parentheses in the "Modules" column indicates the length of the indicated feature in amino acid residues;

FIG. 5 lists the predicted xylanases, xylosidases and related accessories of M. degradans 2-40. The abbreviations are as defined in FIG. 4 with the following additions: xyn=xylan depolymerase, XVI=xylosidases, aqu=alpha glucuronidase, axe=acetylxylanesterase, arb=arabinofuranosidase, xyl/arb=bifunctional enzyme capable of exo-cleavage of β-xylose and α-arabinose monomers from chains of arabinoxylans and other xylose and arabinose substituted chains, CE=carbohydrate esterase family domain, and Y 94 is a novel domain identified during CAZyme analysis, also found in rCbm2C (see FIG. 11);

FIG. 6 lists the predicted pectinases and related accessories of S. degradans 2-40. The molecular weight (MW) and amino acid count was calculated using the protParam tool at the Expasy website (http://us.expasy.orq/tools/) based on the DOE/JGI gene model amino acid sequence translations and includes any predicted signal peptide. Predicted function and GH, GT, PL, CE and CBM modules were determined according to CAZy ModO analysis by B. Henrissat, AFMB-CRNS. Refseq accession numbers of gene model amino acid sequences are from the Entrez protein database (http://www.ncbi.nlm.nih.gov/pubmed). Abbreviations in the "Name" column include: pel=pectate lyase, pes=pectin methylesterase, rgl=rhamnogalacturonan lyase. Abbreviations in the "Modules" column include: CE=carbohydrate esterase, FN3=fibronectin type3-like domain, LPB=lipobox motif, PL=pectase lyase, PSR=polyserine region, and EPR=glutamic acid-proline rich region. The number in parentheses in the "Modules" column indicates the length of the indicated feature in amino acid residues;

FIG. 7 lists the arabinanases and arabinogalactanases of S. degradans 2-40, The abbreviations are as defined in FIG. 6;

FIG. 8 lists the mannanases of S. degradans 2-40. The abbreviations are as defined in FIG. 6. In addition, abbreviations in the "Name" column include man=β-1,4,mannanase and agl=alpha galactosidase, abbreviations in the "Modules" column include: LQAC=putative novel lipobox sequence;

FIG. 9 lists the laminarinases of S. degradans 2-40. The molecular weight (MW) and amino acid count was calculated using the protParam tool at the Expasy website (http://us.expasy.org/tools/) based on the DOE/JGI gene model amino acid sequence translations and includes any predicted signal peptide. Predicted function and GH, GT, PL, CE and CBM modules were determined according to CAZy ModO analysis by B. Henrissat, AFMB-CRNS. Refseq accession numbers of gene model amino acid sequences are from the Entrez protein database (http://www.ncbi.nlm.nih.gov/pubmed). Abbreviations in the "Name" column include: lam=laminarase. Abbreviations in the "Modules" column include: TSP3=thrombospondin type 3 repeats, COG3488=thiol-oxidoreductase like domain of unknown function (similar domain found in cbm32A, see FIG. 10), PSD=polyserine domain, TMR=predicted transmembrane region, FN3=fibronectin type3-like domain, EPR=glutamic acid-proline rich region, CADG=cadherin-like calcium binding motif. The number in parentheses in the "Modules" column indicates the length of the indicated feature in amino acid residues;

FIG. 10 lists selected carbohydrate-binding module proteins of S. degradans 2-40. The abbreviations are defined in FIG. 4. In addition, abbreviations in the "Name" column include: cbm=carbohydrate binding module, and abbreviations in the "Modules" column include: Y94=novel domain identified in this protein as well as two xylanases: xyn10A and xylarb43G-xyn10D during CAZyme analysis, COG3488=thiol-oxidoreductase like domain (similar domain is found in lam16A: see FIG. 11), ZDP=zinc-dependent protease like domain, FCL=similar fucose lectins from an eel serum proteins, EPR=glutamic acid-proline rich region, PSL=polyserine linker, PTR=Proline-Threonine repeat, and UNK=unknown function. The number in parentheses in the "Modules" column indicates the length of the indicated feature in amino acid residues; and FIG. 11 lists the recombinant proteins of S. degradans 2-40 and a comparison of predicted vs. observed molecular weights thereof. The molecular weight (MW) and amino acid count was calculated using amino acid sequence of recombinant protein including HisTag® and other vector-coded sequence. The "PAGE MW" column is the apparent MW in SDS-PAGER gels. Predicted function and modules were determined according to CAZy ModO analysis by B. Henrissat. Abbreviations in the "Name" column include: cab=calcium-binding protein, cel=cellulose, qly=glycanase of uncertain specificity, and lam=laminarase. The dagger (†) in the "PAGE MW" column indicates that Cbm2D-10A appears as three bands ranging from 15 to 25 kDa in anti-HisTaq western blots. Abbreviations in the "Modules" column include: LPB=lipobox motif, LGL=domain of unknown function with weak laminin homology, PSD=polyserine domain, FN3=fibronectin type3-like domain, TSP3=thrombospondin type 3 repeats, COG4388=thiol-oxidoreductase like domain, EPR=glutamic acid-proline rich region, TMR=predicted transmembrane region, Y94=novel domain identified this protein as well as two xylanases. The number in parentheses in the "Modules" column indicates the length of the indicated feature in amino acid residues.

DETAILED DESCRIPTION

Figure 1A:
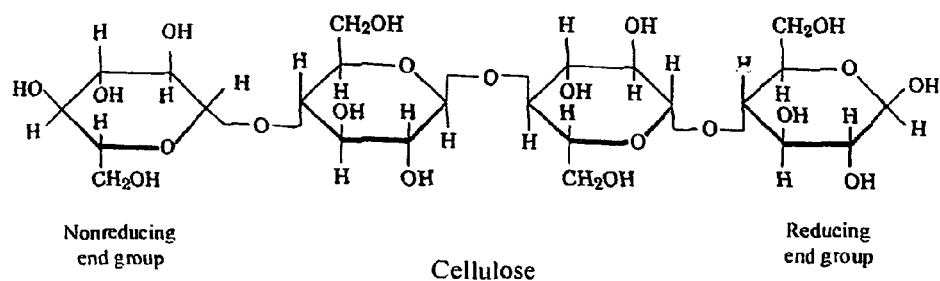
FIG. 1A shows the chemical formula of cellulose, showing β-linked bonds between glucose units as well as reducing and non-reducing ends.

Analysis of the genome sequence of S. degradans 2-40 reveals an abundance of genes coding for enzymes that are predicted to degrade plant-derived carbohydrates. To date, 2-40 is the only sequenced marine bacterium with apparently complete cellulase and xylanase systems, as well as a number of other systems containing plant-wall active carbohydrases.

Thus it appears that 2-40 can play a significant role in the marine carbon cycle, functioning as a "super-degrader" that mediates the breakdown of CP from various algal, plantal, and invertebrate sources. The remarkable enzymatic diversity, novel surface features (ES), and the apparent localization of carbohydrases to ES make S. degradans 2-40 an intriguing organism in which to study the cell biology of CP metabolism and surface enzyme attachment.

It has now been discovered that 2-40 has a complete complement of enzymes, suitably positioned, to degrade plant cell walls. This has been accomplished by the following approaches: a) annotation and genomic analysis of 2-40 plant-wall active enzyme systems, b) identification of enzymes and other proteins which contain domains or motifs that may be involved in surface enzyme display, c) the development of testable models based on identified protein motifs, and d) cloning and expression of selected proteins for the production of antibody probes to allow testing of proposed models of surface enzyme display using immunoelectron microscopy.

These efforts have been greatly facilitated by the recent sequencing of the genome of 2-40, allowing a strategy where genes which code for proteins with potential involvement in surface attachment may be identified based on sequence homology with modules or domains known to function in surface attachment and/or adhesion.

Enzymatic and non-enzymatic ORFs with compelling sequence elements are identified using BLAST and other amino acid sequence alignment and analysis tools. Genes of interest can be cloned into E. coli, expressed with in-frame polyhistidine affinity tag fusions and purified by nickel ion chromatography, thus providing the means of identifying and producing recombinant 2-40 proteins for study and antibody probe production.

The genome sequence of 2-40 was recently obtained in conjunction with the Department of Energy's Joint Genome Initiative (JGI). The finished draft sequence dated Jan. 19, 2005 comprises 5.1 Mbp contained in a single contiguous sequence. Automated annotation of open reading frames (ORFs) was performed by the computational genomics division of the Oak Ridge National Laboratory (ORNL), and the annotated sequence is available on the World Wide Web The initial genome annotation has revealed a variety of carbohydrases, including a number of agarases, alginases and chitinases. Remarkably, the genome also contains an abundance of enzymes with predicted roles in the degradation of plant cell wall polymers, including a number of ORFs with homology to cellulases, xylanases, pectinases, and other glucanases and glucosidases. In all, over 180 open reading frames with a probable role in carbohydrate catabolism were identified in the draft genome.

To begin to define the cellulase, xylanase and pectinase systems of 2-40, genes were initially classified as belonging to one of those systems by BLAST homology. Ambiguous ORFs were tentatively assigned to the class of the best known hit. Other tools used to refine this tentative classification include Pfam (Protein families database of alignments and HMMs) and SMART (Simple Modular Architecture Research Tool) which use multiple alignments and hidden Markov models (statistical models of sequence consensus homology) to identify discreet modular domains within a protein sequence. These analyses were relatively successful; however, a number of ORFs remained difficult to classify based on sequence homology alone.

Enzymes have traditionally been classified by substrate specificity and reaction products. In the pre-genomic era, function was regarded as the most amenable (and perhaps most useful) basis for comparing enzymes and assays for various enzymatic activities have been well-developed for many years, resulting in the familiar EC classification scheme. Cellulases and other O-Glycosyl hydrolases, which act upon glycosidic bonds between two carbohydrate moieties (or a carbohydrate and non-carbohydrate moiety—as occurs in nitrophenol-glycoside derivatives) are designated as EC 3.2.1.-, with the final number indicating the exact type of bond cleaved. According to this scheme an endo-acting cellulase (1,4-β-endoglucanase) is designated EC 3.2.1.4.

With the advent of widespread genome sequencing projects and the ease of determining the nucleotide sequence of cloned genes, ever-increasing amounts of sequence data have facilitated analyses and comparison of related genes and proteins on an unprecedented scale. This is particularly true for carbohydrases; it has become clear that classification of such enzymes according to reaction specificity, as is seen in the E.C. nomenclature scheme, is limited by the inability to convey sequence similarity. Additionally, a growing number of carbohydrases have been crystallized and their 3-D structures solved.

One of the major revelations of carbohydrase sequence and structure analyses is that there are discreet families of enzymes with related sequence, which contain conserved three-dimensional folds that can be predicted based on their amino acid sequence. Further, it has been shown that enzymes with the same three-dimensional fold exhibit the same stereospecificity of hydrolysis, even when they catalyze different reactions (Henrissat, Teeri et al. 1998; Coutinho and Henrissat 1999).

These findings form the basis of a sequence-based classification of carbohydrase modules which is available in the form of an Internet database, the Carbohydrate-Active enZYme server (CAZy) (Coutinho and Henrissat 1999; Coutinho and Henrissat 1999).

CAZy defines four major classes of carbohydrases, based on the type of reaction catalyzed: Glycosyl Hydrolases (GH's), Glycosyltransferases (GT's), Polysaccharide Lyases (PL's), and Carbohydrate Esterases (CE's). GH's cleave glycosidic bonds through hydrolysis. This class includes many familiar polysaccharidases such as cellulases, xylanases, and agarases. GT's generally function in polysaccharide synthesis, catalyzing the formation of new glycosidic bonds through the transfer of a sugar molecule from an activated carrier molecule, such as uridine diphosphate (UDP), to an acceptor molecule. While GT's often function in biosynthesis, there are examples where the mechanism is exploited for bond cleavage, as occurs in the phosphorolytic cleavage of cellobiose and cellodextrins (Lou, Dawson et al. 1996). PL's use a β-elimination mechanism to mediate bond cleavage and are commonly involved in alginate and pectin depolymerization. CE's generally act as deacetylases on O- or N-substituted polysaccharides. Common examples include xylan and chitin deacetylases. Sequence-based families are designated by number within each class, as is seen with GH5: glycosyl hydrolase family 5. Members of GH5 hydrolyze β-1,4 bonds in a retaining fashion, using a double-displacement mechanism which results in retention of the original bond stereospecificity. Retention or inversion of anomeric configuration is a general characteristic of a given GH family (Henrissat and Bairoch 1993; Coutinho and Henrissat 1999). Many examples of endocellulases, xylanases and mannanases belonging to GH5 have been reported, illustrating the variety of substrate specificity possible within a GH family. Also, GH5s are predominantly endohydrolases—cleaving chains of their respective substrates at random locations internal to the polymer chains. While true for GH5, this generalization does not hold for many other GH families. In addition to carbohydrases, the CAZy server defines numerous families of Carbohydrate Binding Modules (CBM). As with catalytic modules, CBM families are designated based on amino acid sequence similarity and conserved three-dimensional folds.

The CAZyme structural families have been incorporated into a new classification and nomenclature scheme, developed by Bernard Henrissat and colleagues (Henrissat, Teeri et al. 1998). Traditional gene/protein nomenclature assigns an acronym indicating general function and order of discovery; in this scheme an organism's cellulase genes are designated celA, celB, etc., regardless of their actual mechanism of action on cellulose. Some researchers have attempted to convey more information by naming cellulases as endoglucanases (engA, engB) or cellobiohydrolases (cbhA, cbhB), however this requires determination of function in vitro and still fails to convey relatedness of protein sequence and structure. CAZyme nomenclature retains the familiar acronym to indicate the functional system a gene belongs to and incorporates the family number designation. Capital letters after the family number indicate the order of report within a given organism system. An example is provided by two endoglucanases, CenA and CenB, of *Cellulomonas fimi*. In the old nomenclature nothing can be deduced from the names except order of discovery. Naming them Cel6A and Cel9A, respectively, makes it immediately clear that these two cellulases are unrelated in sequence, and so belong to different GH families (where Cel stands for cellulase, and 9 for glycosyl hydrolase family nine). While this scheme does not distinguish between endo- and exo-activity, these designations are not absolute and can be included in discussion of an enzyme when relevant (i.e. the cellobiohydrolase Cel6A, the endoxylanase Xyn10B). Catalytic modules take precedence in naming carbohydrases; since many (or even most) carbohydrases contain at least one CBM, they are named for their enzymatic module. If more than one catalytic domain is present, they are named in order from N-terminus to C-terminus, i.e. cel9A-cel48A contains a GH9 at the amino-terminus and a GH48 at the carboxy-terminus. Both domains act against cellulose. There are, however, many examples of CBM modules occurring on proteins with no predicted carbohydrase module. In the absence of some other predicted functional domain (like a protease) these proteins are named for the CBM module family. If there are multiple CBM families present, then naming is again from amino to carboxy end, i.e. cbm2D-cbm10A (Henrissat, Teeri et al. 1998). This nomenclature has been widely accepted and will be used in the naming of all 2-40 plant-wall active carbohydrases and related proteins considered as part of this study.

Figure 1B:
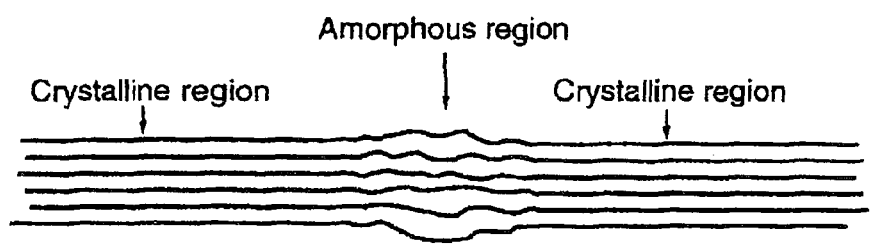
FIG. 1B illustrates the physical structure of a cellulose microfibril. The solid lines represent individual cellulose chains. Crystalline regions have well ordered inter-chain hydrogen bonding, while areas with less ordered bonding are referred to as amorphous.

The cell walls of higher plants are comprised of a variety of carbohydrate polymer (CP) components. These CP interact through covalent and non-covalent means, providing the structural integrity plants required to form rigid cell walls and resist turgor pressure. The major CP found in plants is cellulose, which forms the structural backbone of the cell wall. See FIG. 1A. During cellulose biosynthesis, chains of poly-β-1, 4-D-glucose self associate through hydrogen bonding and hydrophobic interactions to form cellulose microfibrils which further self-associate to form larger fibrils. Cellulose microfibrils are somewhat irregular and contain regions of varying crystallinity. The degree of crystallinity of cellulose fibrils depends on how tightly ordered the hydrogen bonding is between its component cellulose chains. Areas with less-ordered bonding, and therefore more accessible glucose chains, are referred to as amorphous regions (FIG. 1B). The relative crystallinity and fibril diameter are characteristic of the biological source of the cellulose (Beguin and Aubert 1994; Tomme, Warren et al. 1995; Lynd, Weimer et al. 2002). The irregularity of cellulose fibrils results in a great variety of altered bond angles and steric effects which hinder enzymatic access and subsequent degradation.

Figure 2A:
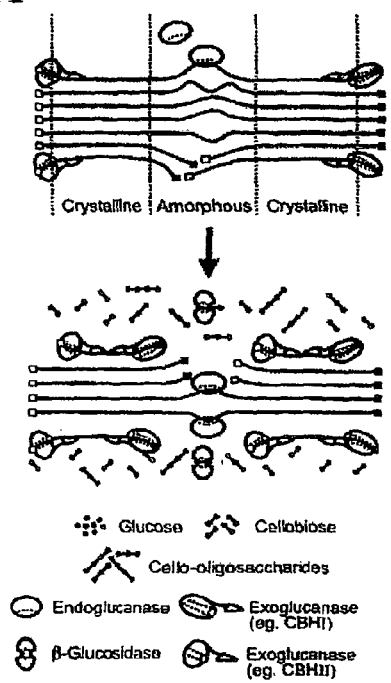
FIG. 2A illustrates the degradation of cellulose fibrils, initiated at amorphous regions by endoglucanases and at chain ends by exoglucanases (cellobiohydrolases) which are specific for reducing or non-reducing ends. The action of endoglucanases greatly increases the availability of chain ends for exoglucanases. B-Glucosidase is a synonym for cellobiase.
Figure 2B:
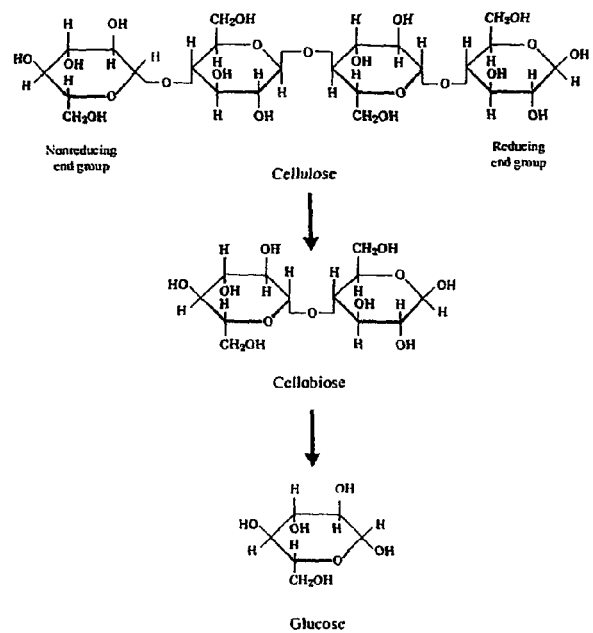
FIG. 2B shows the chemical representation of cellulose degradation to cellobiose and glucose, indicating bond confirmation, reducing and non-reducing ends.

The general model for cellulose depolymerization to glucose involves a minimum of three distinct enzymatic activities (See FIGS. 2A and 2B). Endoglucanases cleave cellulose chains internally to generate shorter chains and increase the number of accessible ends, which are acted upon by exoglucanases. These exoglucanases are specific for either reducing ends or non-reducing ends and frequently liberate cellobiose, the dimer of cellulose (cellobiohydrolases). The accumulating cellobiose is cleaved to glucose by cellobiases (β-1,4-glucosidases). In many systems an additional type of enzyme is present: cellodextrinases are β-1,4-glucosidases which cleave glucose monomers from cellulose oligomers, but not from cellobiose. Because of the variable crystallinity and structural complexity of cellulose, and the enzymatic activities required for is degradation, organisms with "complete" cellulase systems synthesize a variety of endo and/or exo-acting β-1,4-glucanases.

For example, *Cellulomonas fimi* and *Thermomonospora fusca* have each been shown to synthesize six cellulases while *Clostridium thermocellum* has as many as 15 or more (Tomme, Warren et al. 1995). Presumably, the variations in the shape of the substrate-binding pockets and/or active sites of these numerous cellulases facilitate complete cellulose degradation (Warren 1996). Organisms with complete cellulase systems are believed to be capable of efficiently using plant biomass as a carbon and energy source while mediating cellulose degradation. The ecological and evolutionary role of incomplete cellulose systems is less clear, although it is believed that many of these function as members of consortia (such as ruminal communities) which may collectively achieve total or near-total cellulose hydrolysis (Ljungdahl and Eriksson 1985; Tomme, Warren et al. 1995).

In the plant cell wall, microfibrils of cellulose are embedded in a matrix of hemicelluloses (including xylans, arabinans and mannans), pectins (galacturonans and galactans), and various β-1,3 and β-1,4 glucans. These matrix polymers are often substituted with arabinose, galactose and/or xylose residues, yielding arabinoxylans, galactomannans and xyloglucans—to name a few (Tomme, Warren et al. 1995; Warren 1996; Kosugi, Murashima et al. 2002; Lynd, Weimer et al. 2002). The complexity and sheer number of different glycosyl bonds presented by these non-cellulosic CP requires specific enzyme systems which often rival cellulase systems in enzyme count and complexity. Because of its heterogeneity, plant cell wall degradation often requires consortia of microorganisms (Ljungdahl and Eriksson 1985; Tomme, Warren et al. 1995).

Objectives—$S.$ $degradans$ and $M.$ $degradans$ synthesize complete multi-enzyme systems that degrade the major structural polymers of plant cell walls. A) define cellulase and xylanase systems, determining the activities of genes for which function cannot be predicted by sequence homology; and B) genomic identification and annotation of other plant-degrading enzyme systems by sequence homology (i.e. pectinases, laminarinases, etc.).

All publications, patents and patent applications are herein expressly incorporated by reference in their entirety to the same extent as if each individual publication, patent or patent application was specifically and indicated individually to be incorporated by reference in its entirety.

The following examples illustrate but are not intended in any way to limit the scope of the invention.

Experimental Results

I: Genomic, Proteomic and Functional Analyses of 2-40 Plant-Wall Active Enzymes

From the ORNL annotation it is clear that the 2-40 genome contains numerous enzymes with predicted activity against plant cell wall polymers. This is particularly surprising since 2-40 is an estuarine bacterium with several complex enzyme systems that degrade common marine polysaccharides such as agar, alginate, and chitin. Defining multienzyme systems based on automated annotations is complicated by the presence of poorly conserved domains and/or novel combinations of domains. There are many examples of this in the plant-wall active enzymes of 2-40. Accordingly, the ORNL annotations of carbohydrase ORFs were manually reviewed with emphasis on the modular composition and then assigned to general groups based on the substrate they were likely to be involved with (i.e. cellulose or xylan degradation). These genomic sequence analyses resulted in a pool of about 25 potential cellulases, 11 xylanases and 17 pectinases.

When sequence homology is well-conserved, highly accurate predictions of function are possible. Therefore, to verify the presence of functioning cellulase and xylanase systems in $M.$ $degradans$, zymograms and enzyme activity assays were performed as discussed below. Also, attempts were made to identify enzymes from 2-40 culture supernatants using Mass Spectrometry based proteomics.

Next, more sophisticated genomic analyses were used to predict function where possible and to identify ORFs which require functional characterization to determine their roles, if any, in the cellulase and xylanase systems. ORFs which belong to other plant wall-active enzyme systems were tentatively classified based on the sequence analyses and functional predictions of B. Henrissat.

To gain insight into the induction and expression of 2-40 cellulases and xylanases, specific activities were determined for avicel and xylan-grown cells and supernatants by dinitrosalicylic acid reducing-sugar assays (DNSA assays), as discussed in the Experimental Protocols section at the end of this proposal. Xylanase activity was measured for avicel-grown cultures, and vice versa, in order to investigate possible co-induction of activity by these two substrates which occur together in the plant cell wall.

Growth on either avicel or xylan yields enzymatic activity against both substrates, suggesting co-induction of the cellulase and xylanase systems. As with other 2-40 carbohydrase systems, highest levels of activity were induced by the homologous substrate. The results also reveal some key differences in the expression of these two systems. When grown on avicel, cellulase activity is cell-associated in early growth and accumulates significantly in late-stage supernatants. Cell and supernatant fractions exhibit low levels of xylanase activity that remain roughly equal throughout all growth phases. In contrast, xylan-grown cultures exhibit the majority of xylanase and cellulase activity in the cellular fraction throughout the growth cycle. Cellulase activity does not accumulate in the supernatant and xylanase activity accumulates modestly, but still remains below the cell-bound activity.

Figure 3:
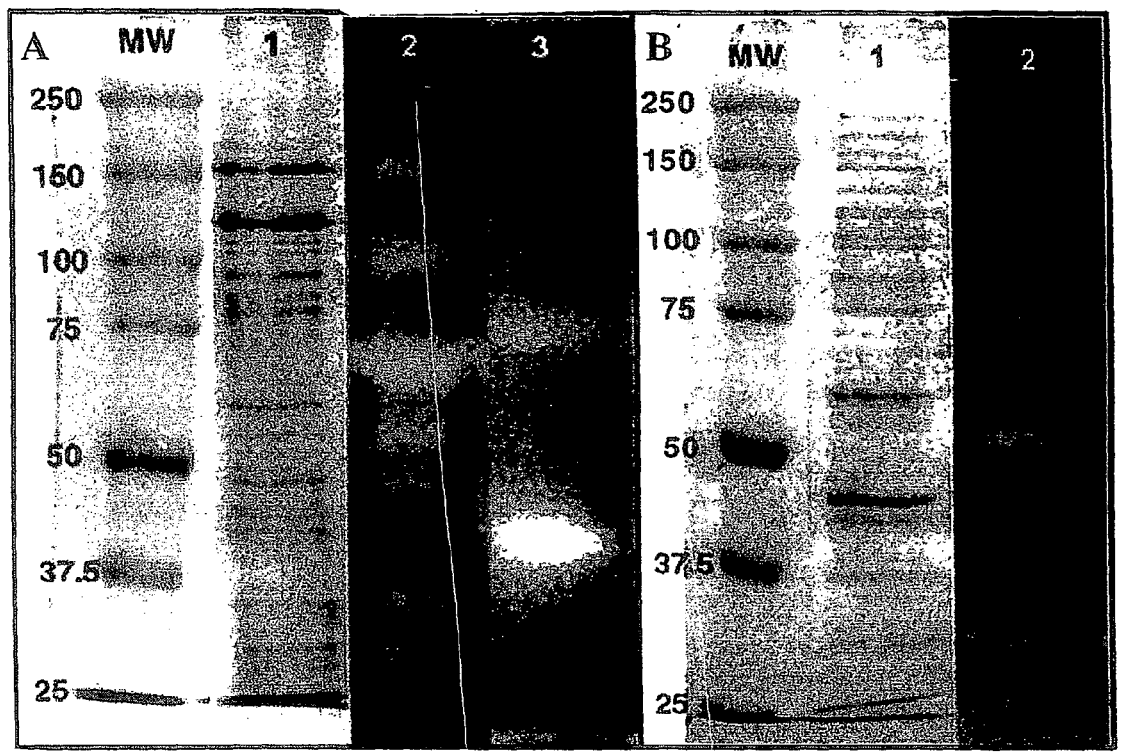
FIG. 3 shows SDS-PAGE and Zymogram analysis of 2-40 culture supernatants.

Enzyme activity gels (zymograms) of avicel and xylan grown cell pellets and culture supernatants were analyzed to visualize and identify expressed cellulases and xylanases. The zymograms revealed five xylanolytic bands in xylan-grown supernatants (FIG. 3), four of which correspond well with the calculated MW of predicted xylanases (xyl/arb43G-xyn10D: 129.6 kDa, xyn10E: 75.2 kDa, xyn10C: 42.3 kDa, and xyn11A: 30.4 kDa; see Table 2). Avicel-grown cultures showed eight active bands with MWs ranging from 30-150 kDa in CMC zymograms. CMC is generally a suitable substrate for endocellulase activity. These zymograms clearly demonstrate that 2-40 synthesizes a number of endocellulases of varied size during growth on avicel-indicative of a functioning multienzyme cellulase system. Together, the CMC and xylan zymograms confirm the results of the genomic analyses and the inducible expression of multienzyme cellulase and xylanase systems in $M.$ $degradans$ 2-40.

To identify individual cellulases and xylanases produced during growth on CP, culture supernatants were subjected to proteomic analysis using reversed-phase high-performance liquid chromatography (RP-HPLC) coupled with tandem Mass Spectrometry (MS/MS). The power resulting from separating the peptides on the RP-HPLC column prior to electrospray ionization and MS/MS analysis allows the identification of a great number of proteins from complex samples (Smith, Loo et al. 1990; Shevchenko, Wilm et al. 1996; Jonsson, Aissouni et al. 2001). These analyses confidently identified over 100 different non-enzymatic proteins and a number of carbohydrases, including a xylanase, two xylosidases, a cellulase, and two cellodextrinases. An agarase was identified during additional analyses of agarose-grown supernatant.

Gel-slice digestion, extraction, and MS/MS analyses performed at the Stanford University Mass Spectrometry facility identified two annotated cellulases from an avicel-grown supernatant sample. One, designated cel5H, has a predicted MW of 67 kDa and was identified from a band with an apparent MW of 75 kDa. The other, cel9B, has a predicted MW of 89 kDa, but an apparent MW of 120 kDa. The discrepancy between the predicted and apparent MW of cel9B is consistent with similar instances where certain 2-40 proteins, cloned and expressed in *E. coli*, exhibit apparent MWs which are 30-40% higher than their predicted MW.

The amino acid translations of all gene models in the 2-40 draft genome were analyzed on the CAZy ModO (Carbohydrase Active enzyme Modular Organization) server at AFMB-CRNS. This analysis identified all gene models that contain a catalytic module (GH, GT, PL, or CE) and/or a CBM. In all, the genome contains 222 gene models containing CAZy domains, most of which have modular architecture. Of these, 117 contain a GH module, 39 have GTs, 29 PLs, and 17 CE. Many of these carry one or more CBM from various families. There are also 20 proteins that contain a CBM but no predicted carbohydrase domain.

Detailed comparisons of 2-40 module sequences to those in the ModO database allowed specific predictions of function for modules where the sequence of the active site is highly conserved. For example, Cel9B (from the gel slice MS/MS) contains a GH9 module which is predicted to function as an endocellulase, a CBM2 and a CBM10 module.

When catalytic module sequences are less conserved, only a general mechanism can be predicted. This is the case with gly5M which contains a GH5 predicted to be either a 1,3 or 1,4 glucanase—sequence analysis cannot be certain which, and so the acronym designation "gly" for glycanase.

The results of this detailed evaluation and analysis were used to assign genes to cellulase, xylanase, pectinase, laminarinase, arabinanase and mannanase systems. Each system was also assigned the relevant accessory enzymes, i.e. cellobiases belong to the cellulase system and xylosidases belong to the xylanase system. Genes with less-conserved GH modules which have the most potential to function as cellulases, xylanases or accessories were identified and designated as needing demonstration of function.

The results of the ORNL annotation, follow-up annotation analyses, proteomic (mass spectrometry) analyses, CAZyme modular analyses and functional predictions have been incorporated into FIGS. 4-11, which contain tables that summarize the predicted plant wall active carbohydrases and selected CBM only genes of 2-40.

The genes chosen for cloning and functional analysis include the carbohydrases gly3C, gly5K, gly5M, gly9C, and gly43M. Because the active site of gly5L is highly homologous to that of gly5K, its activity is inferred from the results obtained from gly5K. Four of the 20 "CBM only" proteins, cbm2A, cbm2B, cbm2C and cbm2D-cbm10A are included in activity assays to investigate their predicted lack of enzymatic function. These four contain CBM2 modules that are predicted to bind to crystalline cellulose. This predicted affinity is the reason for their inclusion in activity assays; those proteins that bind to cellulose are most likely to contain cellulase or xylanase modules which were not detected by sequence analysis. With CBM only proteins, a lack of detected enzyme activity will confirm the absence of a catalytic domain (CD).

In order to define the complete cellulase and xylanase systems of *M. degradans*, those enzymes which may belong to the systems but cannot be confidently assigned based on sequence homology will be expressed, purified and assayed for activity as described in the Experimental Protocols. To date, gly3C, gly5K, gly5M, gly9C and gly43M, as well as cbm2A, cbm2B, cbm2C and cbm2D-cbm10A, have been cloned into expression strains as pETBlue2 (Novagen) constructs. This vector places expression under the control an inducible T7 lac promoter and incorporates a C-terminal 6× Histidine tag, allowing purification of the recombinant protein by nickel ion affinity. Successful cloning and expression of these proteins was confirmed by western blots using α-HisTag® monoclonal antibody (Novagen). All expressed proteins have apparent MWs which are close to, or larger, than their predicted MW (Table 8) except for Cbm2D-Cbm10A which appears to be unstable; two separate attempts to clone and express this protein have resulted in HisTag® containing bands which occur near the dye front in western blots, suggesting proteolytic degradation of this gene product. An additional enzyme, Cel5A, has been cloned and expressed for use as an endocellulase positive control in activity assays. Cel5A has a predicted MW of 129 kDa, contains two GH5 modules, and is highly active in HE-cellulose zymograms.

The major criteria for assigning function will be the substrate acted upon, and the type of activity detected. As such, the various enzyme activity assays will focus on providing a qualitative demonstration of function rather than on rigorously quantifying relative activity levels. The assays required are dictated by the substrate being tested, and are discussed in more detail in Experimental Protocols. For cellulose it is important to distinguish between β-1,4-endoglucanase (endocellulase), β1,4-exoglucanase (cellobiohydrolase), and β-1,4-glucosidase (cellobiase) activities. This will be accomplished using zymograms to assay for endocellulase, DNSA reducing-sugar assays for cellobiohydrolase, and p-nitrophenol-β-1,4-cellobioside (pnp-cellobiose) for cellobiase activity. The combined results from all three assays will allow definition of function as follows: a positive zymogram indicates endocellulase activity, a negative zymogram combined with a positive DNSA assay and a negative pnp-cellobiose assay indicates an exocellulase, while a negative zymogram and DNSA with a positive pnp-cellobiose result will imply that the enzyme is a cellobiase.

Xylanase (β-1,4-xylanase), laminarinase (β-1,3-glucanase), and mixed glucanase (β-1,3(4)-glucanase) activity will be determined by xylan, laminarin and barley glucan zymograms, respectively. Unlike cellulose, there do not appear to be any reports of "xylobiohydrolases" or other exo-acting enzymes which specifically cleave dimers from these substrates. Thus zymograms will suffice for demonstrating depolymerase (endo) activity and pnp-derivatives will detect monosaccharide (exo) cleavage. The pnp-derivatives used in this study will include pnp-α-L-arabinofuranoside, -α-L-arabinopyranoside, -β-L-arabinopyranoside, -β-D-cellobioside, -α-D-xylopyranoside and -β-D-xylopyranoside. These substrates were chosen based on the possible activities of the domains in question. The assays will allow determination of function for any α- and β-arabinosidases, β-cellobiases, β-xylosidases, bifunctional α-arabinosidase/β-xylosidases, and α-xylosidases—which cleave α-linked xylose substituents from xyloglucans. The pnp-derivative assays will be run in 96-well microtiter plates using a standard curve of p-nitrophenol concentrations, as discussed in Experimental Protocols.

The combination of assays for β-1,4-, β-1,3-, and β-1,3(4)-glucanase activities, as well as for β-1,4-xylanase and the various exo-glycosidase activities should clearly resolve the function of the ambiguous carbohydrases. Proteins with demonstrated activity will be assigned to the appropriate enzyme system.

Experimental Protocols

Zymograms

All activity gels were prepared as standard SDS-PAGE gels with the appropriate CP substrate incorporated directly into the separating gel. Zymograms are cast with 8% polyacrylamide concentration and the substrate dissolved in dH$_2$O and/or gel buffer solution to give a final concentration of 0.1% (HE-cellulose), 0.15% (barley β-glucan), or 0.2% (xylan). Gels are run under discontinuous conditions according to the procedure of Laemmli (Laemmli 1970) with the exception of an 8 minute treatment at 95° C. in sample buffer containing a final concentration of 2% SDS and 100 mM dithiothreitol (DTT). After electrophoresis, gels are incubated at room temperature for 1 hour in 80 ml of a renaturing buffer of 20 mM PIPES buffer pH 6.8 which contains 2.5% Triton X-100, 2 mM DTT and 2.5 mM $CaCl_2$. The calcium was included to assist the refolding of potential calcium-binding domains such as the tsp3s of Lam16A.

After the 1 hour equilibration, gels were placed in a fresh 80 ml portion of renaturing buffer and held overnight at 4° C. with gentle rocking. The next morning gels were equilibrated in 80 ml of 20 mM PIPES pH6.8 for 1 hour at room temperature, transferred to a clean container, covered with the minimal amount of PIPES buffer and incubated at 37° C. for 4 hours. Following incubation gels were stained for 30 minutes with a solution of either 0.25% Congo red in $dH_2O$ (HE-cellulose, β-glucan and xylan) or 0.01% Toluidine blue in 7% acetic acid. Gels were destained with 1M NaCl for Congo red and $dH_2O$ for Toluidine blue until clear bands were visible against a stained background.

Nelson-Somogyi Reducing-Sugar Assays

Purified proteins were assayed for activity using a modification of the Nelson-Somogyi reducing sugar method adapted for 96-well microtiter plates, using 50 ul reaction volumes (Green, Clausen et al. 1989). Test substrates included avicel, CMC, phosphoric-acid swollen cellulose (PASC), Barley glucan, laminarin, and xylan dissolved at 1% in 20 mM PIPES pH 6.8 (Barley glucan and laminarin, 0.5%). Barley glucan, laminarin and xylan assays were incubated 2 hours at 37° C.; avicel, CMC and PASC assays were incubated 36 hours at 37° C. Samples were assayed in triplicate, corrected for blank values, and levels estimated from a standard curve. Protein concentration of enzyme assay samples was measured in triplicate using the Pierce BCA protein assay according to the manufacture's instructions. Enzymatic activity was calculated, with one unit (U) defined as 1 μM of reducing sugar released/minute and reported as specific activity in U/mg protein.

Exoglycosidase Activity Assays: pnp-Derivatives

Purified proteins were assayed for activity against pNp derivatives of α-L-arabinofuranoside, -α-L-arabinopyranoside, -β-L-arabinopyranoside, -β-D-cellobioside, -α-D-glucopyranoside, -β-D-glucopyranoside, -α-D-xylopyranoside and -β-D-xylopyranoside. 25 μl of enzyme solution was added to 125 μl of 5 mM substrate solution in 20 mM PIPES pH 6.8, incubated for 30 min at 37° C., and $A_{405}$ was determined. After correcting for blank reactions, readings were compared to a p-nitrophenol standard curve and reported as specific activities in U/mg protein, with one unit (U) defined as 1 μmol p-Np/min.

Mass Spectrometry and Proteomic Analyses

Stationary-phase supernatants from avicel, CMC, and xylan-grown cultures were concentrated to ~25× by centrifugal ultrafiltration using microcon or centricon devices (Millipore). Sample protein concentrations were determined by the BCA protein assay. Samples were exchanged into 100 mM Tris buffer, pH 8.5, which also contained 8M urea and 10 mM DTT. Samples were incubated 2 hours at 37° C. with shaking to denature the proteins and reduce disulfide bonds. After reduction, 1M iodoacetate was added to a final concentration of 50 mM and the reaction was incubated 30 minutes at 25° C. in the dark. This step alkylates the reduced cysteine residues, thereby preventing reformation of disulfide bonds. The samples are then exchanged into 50 mM Tris, 1 mM $CaCl_2$, pH 8.5 using microcon devices. The denatured, reduced, and alkylated sample is digested into peptide fragments using proteomics-grade trypsin (Promega) at a 1:50 enzyme (trypsin) to substrate (supernatant) ratio. Typical digestion reactions were around 150 μl total volume. Digestions were incubated overnight at 37° C., stopped by addition of 99% formic acid to a final concentration of ~1% and analyzed by RPHPLC-MS/MS at the UMCP College of Life Sciences CORE Mass Spectrometry facility.

Peptide fragments were loaded onto a Waters 2960 HPLC fitted with a 12 cm microbore column containing $C_{18}$ as the adsorbent and eluted with a linear gradient of increasing acetonitrile ($CH_3CN$) concentration into an electrospray ionization apparatus. The electrospray apparatus ionized and injected the peptides into a Finnagin LCQ tandem Mass Spectrometer. Automated operating software controlled the solvent gradient and continually scanned the eluted peptides. The program identifies each of the three most abundant ion species in a survey scan, isolates each of them in the Mass Spectrometer's ion trap and fragments them by inducing collisions with helium molecules. The resulting sub-fragment masses are recorded for further analysis by peptide analysis packages like SEQUEST and MASCOT. After the three sub-scan and collision cycles have completed, the MS takes another survey scan and the cycle repeats until the end of the run, usually about three hours. The raw MS reads are used by the analysis software to generate peptide fragment sequences, which were compared to amino acid sequence translations of all gene models in the 2-40 draft genome. Peptide identity matches were evaluated using accepted thresholds of statistical significance which are specific for each program.

Cloning and Expression of 2-40 Proteins in *E. coli*

The basic cloning and expression system uses pETBlue2 (Novagen) as the vector, *E. coli* DH5α (Invitrogen) as the cloning strain, and *E. coli* BL-21(DE3) Tuner® cells (Novagen) for protein expression strain. This system allows the cloning of toxic or otherwise difficult genes because the vector places expression under the control of a T7 lac promoter—which is lacking in the cloning strain DH5α, thereby abolishing even low-level expression during plasmid screening and propagation. After the blue/white screen, plasmids are purified from DH5α and transformed into the expression host (Tuners). The Tuner strain has the T7 lac promoter, allowing IPTG-inducible expression of the vector-coded protein and lacks the Lon and Omp proteases.

The nucleotide sequences of gene models were obtained from the DOE JGI's *Microbulbifer degradans* genome web server and entered into the PrimerQuest™ design tool provided on Integrated DNA Technologies web page. The design parameters were Optimum $T_m$ 60° C., Optimum Primer Size 20 nt, Optimum GC %=50, and the product size ranges were chosen so that the primers were selected within the first and last 100 nucleotides of each ORF in order to clone as much of the gene as reasonably possible. The cloning and expression vector, pETBlue2, provides a C-terminal 6× Histidine fusion as well as the start and stop codon for protein expression. Thus, careful attention to the frame of the vector and insert sequences is required when adding 5' restriction sites to the PCR primers. The resulting "tailed primers" were between 26 to 30 nt long, and their sequences were verified by "virtual cloning" analysis using the PDRAW software package. This program allows vector and insert DNA sequences to be cut with standard restriction enzymes and ligated together. The amino acid translations of the resulting sequences were examined to detect any frame shifts introduced by errors in primer design. Following this verification, the primers were purchased from Invitrogen (Frederick, Md.).

PCR reactions contained 10 pMol of forward and reverse primers, 1 μl of 10 mM DNTPs, 1.5 μl of 100 mM $MgCl_2$, and 1 µl Proof Pro® Pfu Polymerase in a 50l reaction with 0.5 µl of 2-40 genomic DNA as the template. PCRs conditions used standard parameters for tailed primers and Pfu DNA polymerase. PCR products were cleaned up with the QIAGEN QIAquick PCR Cleanup kit and viewed in 0.8% agarose gels. Following cleanup and confirmation of size, PCR products and pETBlue2 are digested with appropriate restriction enzymes, usually AscI and ClaI at 37° C. for 1 to 4 hours, cleaned up using the QIAquick kit, and visualized in agarose gels. Clean digestions are ligated using T4 DNA ligase for at least 2 hours in the dark at room temperature. Ligations are then transformed into E. coli DH5α by electroporation. Transformants are incubated one hour at 37° C. in non-selective media, and then plated onto LB agar containing ampicillin and X-gal. As pETBlue2 carries an $Amp^r$ gene and inserts are cloned into the lacZ ORF, white colonies contain the insert sequence. White colonies are picked with toothpicks and patched onto a new LB/Amp/X-gal plate, with three of the patched colonies also being used to inoculate 3 ml overnight broths. Plasmids are prepped from broths which correspond to patched colonies which remained white after overnight outgrowth. These plasmid preps are then singly digested with an appropriate restriction enzyme and visualized by agarose electrophoresis for size confirmation.

The plasmids are then heat-shock transformed into the Tuner® strain, which carries a chromosomal chloramphenicol resistance gene ($Cm^r$). The Transformants are incubated 1 hour at 37° C. in non-selective rescue medium, plated on LB agar with Amp and Cm (Tuner medium) and incubated overnight at 37° C. Any colonies thus selected should contain the vector and insert. This is confirmed by patching three colonies onto a Tuner medium plate and inoculating corresponding 3 ml overnight broths. The next morning the broths are used to inoculate 25 ml broths which are grown to an $OD_{600}$ of around 0.6 (2-3 hours). At this point a 1 ml aliquot is removed from the culture, pelleted and resuspended in $1/10$ volume 1× SDS-PAGE treatment buffer. This pre-induced sample is frozen at −20° C. for later use in western blots. The remaining broth is then amended to 1 mM IPTG and incubated 4 hours at 37° C. Induced pellet samples are collected at hourly intervals. These samples and the pre-induced control are run in standard SDS-PAGE gels and electroblotted onto PVDF membrane. The membranes are then processed as western blots using a $1/5000$ dilution of monoclonal mouse α-HisTag® primary antibodies followed by HRP-conjugated goat α-mouse IgG secondary antibodies. Bands are visualized colorimetrically using BioRad's Opti-4CN substrate kit. Presence of His tagged bands in the induced samples, but not in uninduced controls, confirms successful expression and comparison of bands from the hourly time points are used to optimize induction parameters in later, larger-scale purifications.

Production and Purification of Recombinant Proteins

Expression strains are grown to an $OD_{600}$ of 0.6 to 0.8 in 500 ml or 1 liter broths of tuner medium. At this point a non-induced sample is collected and the remaining culture induced by addition of 100 mM IPTG to a final concentration of 1 mM. Induction is carried out for four hours at 37° C. or for 16 hours at 25° C. Culture pellets are harvested and frozen overnight at −20° C. for storage and to aid cell lysis. Pellets are then thawed on ice for 10 minutes and transferred to pre-weighed falcon tubes and weighed. The cells are then rocked for 1 hour at 25° C. in 4 ml of lysis buffer (8M Urea, 100 mM $NaH_2PO_4$, 25 mM Tris, pH 8.0) per gram wet pellet weight. The lysates are centrifuged for 30 minutes at 15,000 g to pellet cell debris. The cleared lysate (supernatant) is pipetted into a clean falcon tube, where 1 ml of QIAGEN 50% Nickel-NTA resin is added for each 4 ml cleared lysate. This mixture is gently agitated for 1 hour at room temperature to facilitate binding between the $Ni^{+2}$ ions on the resin and the His tags of the recombinant protein. After binding, the slurry is loaded into a disposable mini column and the flow thru (depleted lysate) is collected and saved for later evaluation. The resin is washed twice with lysis buffer that has been adjusted to pH 7.0; the volume of each of these washes is equal to the original volume of cleared lysate. The flow thru of these two washes is also saved for later analysis in western blots to evaluate purification efficiency.

At this point the columns contain relatively purified recombinant proteins which are immobilized by the His tags at their C-terminus. This is an ideal situation for refolding, so the column is moved to a 4° C. room and a series of renaturation buffers with decreasing urea concentrations are passed through the column. The renaturation buffers contain varying amounts of urea in 25 mM Tris pH 7.4, 500 mM NaCl, and 20% glycerol. This buffer is prepared as stock solutions containing 6M, 4M, 2M and 1M urea. Aliquots of these can be easily mixed to obtain 5M and 3M urea concentrations thus providing a descending series of urea concentrations in 1M steps. One volume (the original lysate volume) of 6M buffer is passed through the column, followed by one volume of 5M buffer, continuing on to the 1M buffer—which is repeated once to ensure equilibration of the column at 1M urea. At this point the refolded proteins are eluted in 8 fractions of $1/10^{th}$ original volume using 1M urea, 25 mM Tris pH 7.4, 500 mM NaCl, 20% glycerol containing 250 mM imidazole. The imidazole disrupts the Nickel ion-His tag interaction, thereby releasing the protein from the column.

Western blots are used to evaluate the amount of His tagged protein in the depleted lysate, the two washes, and the eluted fractions. If there is an abundance of recombinant protein in the depleted lysate and/or washes it is possible to repeat the process and "scavenge" more protein. Eluate fractions that contain the protein of interest are pooled and then concentrated and exchanged into storage buffer (20 mM Tris pH 7.4, 10 mM NaCl, 10% glycerol) using centricon centrifugal ultrafiltration devices (Millipore). The enzyme preparations are then aliquoted and frozen at −80° C. for use in activity assays.

In various embodiments of this invention, the cellulose degrading enzymes, related proteins and systems containing thereof, of this invention, for example including one or more enzymes or cellulose-binding proteins, have a number of uses. Many possible uses of the cellulases of the present invention are the same as described for other cellulases in the paper "Cellulases and related enzymes in biotechnology" by M. K. Bhat (Biotechnical Advances 18 (2000) 355-383), the subject matter of which is hereby incorporated by reference in its entirety. For examples, the cellulases and systems thereof of this invention can be utilized in food, beer, wine, animal feeds, textile production and laundering, pulp and paper industry, and agricultural industries.

In one embodiment, these systems can be used to degrade cellulose to produce short chain peptides for use in medicine.

In other embodiments, these systems are used to break down cellulose in the extraction and/or clarification of fruit and vegetable juices, in the production and preservation of fruit nectars and purees, in altering the texture, flavor and other sensory properties of food, in the extraction of olive oil, in improving the quality of bakery products, in brewing beer and making wine, in preparing monogastic and ruminant feeds, in textile and laundry technologies including "fading"

denim material, defibrillation of lyocell, washing garments and the like, preparing paper and pulp products, and in agricultural uses.

In some embodiments of this invention, cellulose may be used to absorb environmental pollutants and waste spills. The cellulose may then be degraded by the cellulase degrading systems of the present invention. Bacteria that can metabolize environmental pollutants and can degrade cellulose may be used in bioreactors that degrade toxic materials. Such a bioreactor would be advantageous since there would be no need to add additional nutrients to maintain the bacteria—they would use cellulose as a carbon source.

In some embodiments of this invention, cellulose degrading enzyme systems can be supplied in dry form, in buffers, as pastes, paints, micelles, etc. Cellulose degrading enzyme systems can also comprise additional components such as metal ions, chelators, detergents, organic ions, inorganic ions, additional proteins such as biotin and albumin.

In some embodiments of this invention, the cellulose degrading systems of this invention could be applied directly to the cellulose material. For example, a system containing one, some or all of the compounds listed in FIGS. 4-11 could be directly applied to a plant or other cellulose containing item such that the system would degrade the plant or other cellulose containing item. As another example, 2-40 could be grown on the plant or other cellulose containing item, which would allow the 2-40 to produce the compounds listed in FIGS. 4-11 in order to degrade the cellulose containing item as the 2-40 grows. An advantage of using the 2-40 or systems of this invention is that the degradation of the cellulose containing plant or item can be conducted in a marine environment, for example under water.

It is one aspect of the present invention to provide a nucleotide sequence that has a homology selected from 100%, 99%, 98%, 97%, 96%, 95%, 90%, 85%, 80%, or 75% to any of the sequences of the compounds listed in FIGS. 4-11

The present invention also covers replacement of between 1 and 20 nucleotides of any of the sequences of the compounds listed in FIGS. 4-11 with non-natural or non-standard nucleotides for example phosphorothioate, deoxyinosine, deoxyuridine, isocytosine, isoguanosine, ribonucleic acids including 2-O-methyl, and replacement of the phosphodiester backbone with, for example, alkyl chains, aryl groups, and protein nucleic acid (PNA).

It is another aspect of some embodiments of this invention to provide a nucleotide sequence that hybridizes to any one of the sequences of the compounds listed in FIGS. 4-11 under stringency condition of 1×SSC, 2×SSC, 3×SSC1, 4×SSC, 5×SSC, 6×SSC, 7×SSC, 8×SSC, 9×SSC, or 10×SSC.

The scope of this invention covers natural and non-natural alleles of any one of the sequences of the compounds listed in FIGS. 4-11. In some embodiments of this invention, alleles of any one of any one of the sequences of the compounds listed in FIGS. 4-11 can comprise replacement of one, two, three, four, or five naturally occurring amino acids with similarly charged, shaped, sized, or situated amino acids (conservative substitutions). The present invention also covers non-natural or non-standard amino acids for example selenocysteine, pyrrolysine, 4-hydroxyproline, 5-hydroxylysine, phosphoserine, phosphotyrosine, and the D-isomers of the 20 standard amino acids.

Some embodiments of this invention are directed to a method for producing ethanol from lignocellulosic material, comprising treating lignocellulosic material with an effective saccharifying amount of one or more compounds listed in FIGS. 4-11, preferably cellulase cel5A listed in FIG. 4, to obtain saccharides and converting the saccharides to produce ethanol. The treating may be conducted in a marine environment, such as under water. The one or more compounds listed in FIGS. 4-11 may be present in dry form, in a buffer, or in the form of a paste, paint, or micelle.

Conversion of sugars to ethanol and recovery may be accomplished by, but are not limited to, any of the well-established methods known to those of skill in the art. For example, through the use of an ethanologenic microorganism, such as *Zymomonas, Erwinia, Klebsiella, Xanthomonas*, and *Escherichia*, preferably *Escherichia coli* K011 and *Klebsiella oxytoca* P2.

In further aspects of the present invention, the lignocellulosic material is treated with an effective saccharifying amount of all of the compounds listed in FIGS. 4-11.

In further aspects of the present invention, the one or more compounds listed in FIGS. 4-11 are from *Microbulbifer degradans* 2-40.

In further aspects of the present invention, the one or more compounds listed in FIGS. 4-11 are in a system consisting essentially of one or more compounds listed in FIGS. 4-11 or a system further comprising metal ions, chelators, detergents, organic ions, inorganic ions, or one or more additional proteins, such as biotin and/or albumin.

Some embodiments of this invention are directed to ethanol produced by treating lignocellulosic material with an effective saccharifying amount of one or more compounds listed in FIGS. 4-11 to obtain saccharides and converting the saccharides to produce ethanol. Conversion of sugars to ethanol and recovery may be accomplished by, but are not limited to, any of the well-established methods known to those of skill in the art. For example, through the use of an ethanologenic microorganism, such as *Zymomonas, Erwinia, Klebsiella, Xanthomonas*, and *Escherichia*, preferably *Escherichia coli* K011 and *Klebsiella oxytoca* P2.

Further embodiments of this invention are directed to a method for producing ethanol from lignocellulosic material, comprising contacting lignocellulosic material with a microorganism expressing an effective saccharifying amount of one or more compounds listed in FIGS. 4-11, preferably cellulase cel5A listed in FIG. 4, to obtain saccharides and converting the saccharides to produce ethanol. The contacting may be conducted in a marine environment, such as under water. The microorganism may be *Microbulbifer degradans* 2-40 or a recombinant microorganism containing a chimeric gene comprising at least one polynucleotide encoding a polypeptide comprising an amino acid sequence of at least one of the compounds listed in FIGS. 4-11; wherein the gene is operably linked to regulatory sequences that allow expression of the amino acid sequence by the microorganism. The recombinant microorganism, may be a bacteria or yeast, such as *Escherichia coli*. In some aspects of the present invention, the recombinant microorganism is an ethanologenic microorganism, such as microorganisms from the species *Zymomonas, Erwinia, Klebsiella, Xanthomonas*, or *Escherichia*, preferably *Escherichia coli* K011 or *Klebsiella oxytoca* P2.

Further aspects of the present invention are directed to ethanol produced by contacting lignocellulosic material with a microorganism expressing an effective saccharifying amount of one or more compounds listed in FIGS. 4-11 to obtain saccharides and converting the saccharides to produce ethanol.

A further aspect of the invention is directed to a method for producing ethanol from lignocellulosic material, comprising contacting lignocellulosic material with an ethanologenic microorganism expressing an effective saccharifying amount of one or more compounds listed in FIGS. 4-11 to produce ethanol. The ethanologenic microorganism expresses an effective amount of one or more compounds listed in FIGS. 4-11 to saccharify the lignocellulosic material and an effective amount of one or more enzymes or enzyme systems which, in turn, catalyze (individually or in concert) the conversion of the saccharides (e.g., sugars such as xylose and/or glucose) to ethanol. The one or more enzymes or enzyme systems of the ethanologenic organism may be expressed naturally or by, but not limited to, any of the methods known to those of skill in the art. For example, release of the one or more enzymes or enzyme systems may be obtained through the use of ultrasound. In some aspects of the present invention, the ethanologenic microorganism is transformed in order to be able to express one or more of the compounds listed in FIGS. 4-11. In some aspects of the present invention, the ethanologenic microorganism is from the species *Zymomonas, Erwinia, Klebsiella, Xanthomonas*, or *Escherichia*, preferably *Escherichia coli* K011 or *Klebsiella oxytoca* P2.

It is to be understood that while the invention has been described above using specific embodiments, the description and examples are intended to illustrate the structural and functional principles of the present invention and are not intended to limit the scope of the invention. On the contrary, the present invention is intended to encompass all modifications, alterations, and substitutions within the spirit and scope of the appended claims.

REFERENCES CITED

Andrykovitch, G. and I. Marx (1988) "Isolation of a new polysaccharide-digesting bacterium from a salt marsh." Applied and Environmental Microbiology 54: 3-4.

Beguin, P. and J. P. Aubert (1994) "The biological degradation of cellulose." FEMS Microbiol Rev 13(1): 25-58.

Chakravorty, D. (1998). Cell Biology of Alginic Acid degradation by Marine Bacterium 2-40. College Park, University of Maryland.

Coutinho, P. M. and B. Henrissat (1999) Carbohydrate-active enzyme server. http://afmb.cnrs-mrs.fr/~cazy/CAZY/index.html Accessed Jan. 21, 2004

Coutinho, P. M. and B. Henrissat (1999) The modular structure of cellulases and other carbohydrate-active enzymes: an integrated database approach. Genetics, biochemistry and ecology of cellulose degradation. T. Kimura. Tokyo, Uni Publishers Co: 15-23.

Distel, D. L., W. Morrill, et al. (2002) "Teredinibacter turnerae gen. nov., sp. nov., a dinitrogen-fixing, cellulolytic, endosymbiotic gamma-proteobacterium isolated from the gills of wood-boring molluscs (Bivalvia: Teredinidae)." Int J Syst Evol Microbiol 52(6): 2261-2269.

Ensor, L., S. K. Stotz, et al. (1999) "Expression of multiple insoluble complex polysaccharide degrading enzyme systems by a marine bacterium." J Ind Microbiol Biotechnol 23: 123-126.

Gonzalez, J. and R. M. Weiner (2000) "Phylogenetic characterization of marine bacterium strain 2-40, a degrader of complex polysaccharides." International journal of systematic evolution microbiology 50: 831-834.

Henrissat, B. and A. Bairoch (1993) "New families in the classification of glycosyl hydrolases based on amino acid sequence similarities." Biochem J 293 (Pt 3): 781-8.

Henrissat, B., T. T. Teed, et al. (1998) "A scheme for designating enzymes that hydrolyse the polysaccharides in the cell walls of plants." FEBS Lett 425(2): 352-4.

Jonsson, A. P., Y. Aissouni, et al. (2001) "Recovery of gel-separated proteins for in-solution digestion and mass spectrometry." Anal Chem 73(22): 5370-7.

Kelley, S. K., V. Coyne, et al. (1990) "Identification of a tyrosinase from a periphytic marine bacterium." FEMS Microbiol Lett 67: 275-280.

Kosugi, A., K. Murashima, et al. (2002) "Characterization of two noncellulosomal subunits, ArfA and BgaA, from Clostridium cellulovorans that cooperate with the cellulosome in plant cell wall degradation." J Bacteriol 184(24): 6859-65.

Laemmli, U. K. (1970). "Cleavage of structural proteins during the assembly of the head of the bacteriophage T4." Nature 277: 680-685.

Ljungdahl, L. G. and K. E. Eriksson (1985) Ecology of Microbial Cellulose Degradation. Advances in Microbial Ecology. New York, Plenum Press. 8: 237-299.

Lou, J., K. Dawson, et al. (1996) "Role of phosphorolytic cleavage in cellobiose and cellodextrin metabolism by the ruminal bacterium *Prevotella ruminicola*." Appl. Environ. Microbiol. 62(5): 1770-1773.

Lynd, L. R., P. J. Weimer, et al. (2002) "Microbial cellulose utilization: fundamentals and biotechnology." Microbiol Mol Biol Rev 66(3): 506-77, table of contents.

Shevchenko, A., M. Wilm, et al. (1996) "Mass spectrometric sequencing of proteins silver-stained polyacrylamide gels." Anal Chem 68(5): 850-8.

Smith, R. D., J. A. Loo, et al. (1990) "New developments in biochemical mass spectrometry: electrospray ionization." Anal Chem 62(9): 882-99.

Stotz, S. K. (1994). An agarase system from a periphytic prokaryote. College Park, University of Maryland.

Sumner, J. B. and E. B. Sister (1944) "A simple method for blood sugar." Archives of Biochemistry 4: 333-336.

Tomme, P R. A. Warren, et al. (1995) "Cellulose hydrolysis by bacteria and fungi." Adv Microb Physiol 37: 1-81.

Warren, R. A. (1996) "Microbial hydrolysis of polysaccharides." Annu Rev Microbiol 50: 183-212.

Whitehead, L. (1997). Complex Polysaccharide Degrading Enzyme Arrays Synthesized By a Marine Bacterium. College Park, University of Maryland.

SEQUENCE LISTING (214 sequences)

SEQ ID NO: 1 - protein, 1167 aa, Microbulbifer degradans
MTIKRWPFDRKGPPKKPNAKKLLASLAAALSLTAMQSTAAVEPLQTSGNQILVGNQAKALGGHSLFWHNVPAAGSLYNADTVSRLKNDWNSKVIRAAIGVEVPFNSENTYIGNKGSSLAAIDRVVNAAVANDMYVIIDFHTHHADQVENVAHDFFNEVSSRYGHLNNVIYEVFNEPEWCGEHGRWASTIKPYAERVIQTIRNNDPDNLVIVGTTCFSQDVDVAAADPINDVNVAYTLHFYAATPAHQQPLRDKAQTALDRGAPLFVTEWGTTTFTGDGFVDEAQTRTWINWLNERGISHVNWSASTQPESSAIWNGDMTYKHSGLLVGELVQQTNGTTTPPTGEISGPCDLHFVPAKAEAESFCTAKGIQFETTTDTGGGQNMGWLDAGDWVTFDVDVPASGQYLIDYRVASELGDGRFRTEAANGTALGTISVPNTGGWQNWQTHTHTVQLSQGTQTVKLVAETGGWNLNWFEVRAGEVCEGADCPCEGAECPCPDCNGTPVKFEAETFVAMQGVQLENTSDVGGGQNVGYIDSGDWITYNGALPASADNRYVVSYRVARQPSGNAKFKIEQPGGAAVYGEISVPSTGGWQTWTTISHTITIPANANGFALAAIDGGWNINWIEIKPATTQPPEPINPLKLQAEDYINFNDTTPGNEGGAHRSDDVDIQATTDTGGGFNVGWVDAGEWLEYEFFLESPDFYAADVRVASDQTGGALQLQIDGQNVGQAITVGNTGGWQAWTTKNTLIGDLSAGTHTLRVYAQSGPLNLNWVELKRTTPAPATSCFNIAEDRLNVHLDAHCTAGSNLQYNWDFGDGNSATGVATSHSYYTSGTYTITLTVSDTRTTDTSSQQVTVDFSAPAGPVDFYGELMVNGNRIHGEKTGEPAQVRGMSFFWSNTGWGQEKWWNASTVDRMVDEFKVELVRGAMGTDEGGGYLHDASNKARLQAVVEQAIARNVYVIIDWHTHHAEDNIAEAITFFSEMAQLYGHHDNVIFEIYNEPLNTTSWGTIKHYAEQVIPAIRAHSDNLIVVGTRTWSQNVDEAAFDKINDSNTAYALHFYVGSHGNHVRNLAQTALNNGAAIFASEWGIWPNNNYDGMNADDWMNFLDQNKISWANWAISDKVDPNTGQLEPPSMFNPDGSLSSNGQYVVNKLNEYAAQAPWREAIAN

SEQ ID NO: 2 - DNA, 3504 bp, Microbulbifer degradans
atgacaattaaacgttggccgttcgaccgaaaaggcccacctaaaaaacctaacgctaaaaaattactcgcaagcttagcggctgcactaagcttaaccgccatgcaaagcactgcagcggtagagccattacaaaccagcggcaatcaaattcttgttggcaaccaagccaaagcccttggcggccacagcttgttttggcataacgtgccggcagcaggcagcttatacaatgcagatacagtaagcaggcttaagaatgattggaactccaaggttattcgggccgcaattggggttgaagtacctttcaattcagaaaacacctacataggcaataagggcagctcgctggccgcaatagaccgcgtagttaatgccgctgttgccaacgatatgtatgtgattatcgattttcatactcaccatgcagatcaagtagaaaacgttgcccacgactttttcaacgaagtttctagccgttacggtcatttaaacaatgttatttatgaagtatttaacgagccagaatggtgtggcgagcacggtcggtgggcatctaccattaagccctacgccgagcgcgttatccaaaccattcgcaacaatgacccagacaacctagtaatagtaggcactacctgtttctcgcaagatgtagatgtagccgcagccgaccccattaacgatgtaaacgtggcctatacgctacacttttacgcagccacccctgcccaccagcaacccttgcgcgacaaggcccaaaccgcgctcgaccgcggcgcgccactatttgtaaccgaatggggtacaaccacatttacaggtgatggttttgtagatgaggcgcaaacgcgcacatggattaactggttaaacgaacgcggtattagccacgttaactggtcggcgtctacccagccagaaagctcagctatatggaatggcgacatgacctacaagcattcgggcttattggttggcgaactggtgcaacaaacaaatggcacaaccacgccaccaaccggtgaaataagtggcccgtgcgatttacattttgtacctgccaaagccgaggctgaaagcttctgtaccgccaaaggcattcaatttgaaaccaccaccgacacgggcggcggccaaaacatgggctggctagatgccggcgactgggtaacttttgatgtagatgtacctgctagcggccaatatttaatagattaccgcgtagcatcagagctaggtgatggtcggttccgcaccgaagccgccaacggcactgcccttggcacaatatctgtacccaataccggcggctggcagaattggcaaacgcacacacacacagtgcaactctcgcaaggcacacaaaccgttaaactagttgccgaaactggtggctggaacttaaattggtttgaagtgcgcgcaggtgaggtgtgcgaaggcgctgactgcccatgtgaaggagccgaatgcccttgcccagattgcaacggcacaccggttaagtttgaggcagaaacgtttgtggctatgcaaggcgtgcagctagaaaacacatccgatgtgggcggcggccaaaacgttggctacattgatagcggcgactggataacttacaacggggccttgcccgcaagtgcagacaaccgctatgtagtgtcttatagagtagcgcgtcaacctagcggcaatgccaaatttaaaatagaacagccaggtggagcagcggtatatggcgaaatttcggtgcccagcaccggcggctggcaaacatggacaaccattagccacaccataacaattcccgctaacgcaaacggctttgcactagcagcaatagatggcggttggaatataaactggatagaaataaaaccggcgaccactcaaccacccgagccaatcaacccgttaaaacttcaagctgaagattacatcaactttaacgacaccacccccggtaacgaaggcggtgcacacagaagcgatgatgtagatattcaagcaactaccgataccggtggcggttttaatgttggctgggtagacgctggcgaatggctagagtatgagttctttttagagtctcctgatttttatgcagctgatgtacgggttgcttcagaccaaactggcggcgcactgcaactacaaatagatggccaaaacgttggccaagccattaccgttggcaacaccggtggctggcaagcgtggacaaccaaaaacacactcattggcgacctaagtgcaggcacccacacgttgcgtgtatacgcgcaaagcggcccattaaatttaaactgggtagagctaaagcgtacaacgcccgcaccagccacttcgtgttttaatattgccgaagaccgcttaaacgttcacctagatgcgcactgtactgcaggcagcaacctgcaatacaattgggattttggtgacggcaacagcgcaaccggcgtagccactagccacagctactacactagcggcacttacaccattaccttaaccgttagtgatacccgcaccacagacacctctagccaacaggtaacggtagatttttctgcccctgcaggccctgtggatttttacggcgaactaatggtgaatggcaaccgcattcacggcgaaaaaaccggcgaacccgcacaagtacgcggcatgagctttttttggagcaacaccggttggggccaagaaaaatggtggaacgccagcaccgtggaccgcatggttgatgagttcaaagtagaacttgtgcgcggcgcaatgggcactgatgaaggcggcggttatttacacgacgcgtctaataaggctcgcttacaagcagttgttgaacaagccattgcacgcaatgtgtatgtaattatcgactggcacacccaccatgccgaagataacattgccgaagccattacattctttagcgaaatggcgcagctttatggccaccacgacaacgtgattttcgagatttacaacgagccattaaacaccacaagctggggcactattaagcactacgctgaacaagttattcctgctattcgcgctcattccgataatttaattgttgtgggcacgcgcacctggtcgcaaaacgtagacgaagccgcgttcgataaaattaacgacagcaacaccgcctacgccctgcacttttatgttggctcgcacggcaaccacgttcgcaacctagcacaaaccgcactaaacaacggcgcggctatttttgctagcgaatggggaatttggccaaacaacaactacgatggcatgaacgccgacgattggatgaactttttagaccaaaacaaaatatcttgggctaactgggccatatccgacaaagtagaccccaacacaggccaactagaaccacccagcatgttcaacccagacggcagcctaagcagtaatggtcaatatgtagtgaacaaactaaatgaatacgcagcacaagcaccgtggagggaggcaatcgctaattga

SEQ ID NO: 3 - protein, 133 aa, Microbulbifer degradans
MVVSLADNSAGAISCWHAKASPPEELEELLDEELELDELELEEELEELVEELLEELLDELLLDELEDEPLAAPPSLPPPQAVSPAKQLISSADFKKVSFRVQLNAVRVKSKRNINHSRIFLFWLFSHFRSRRC

SEQ ID NO: 4 - protein, 566 aa, Microbulbifer degradans
MFLLDFTRTAFSCTRKLTFLKSALLISCFAGLTACGGGSDGGAASGSSSSSSSSSSSSSSSSSSSTSSSSSSSSSSSSSSSSSSNSSSSSSGGDALACQHEMAPALLSASDTTMVQAEYYDTCASSALDNTTGNSGGELRTDDVDIVAIADGYAITDMQSGEYVEYSLTVQTSGLFDISFAVQPHAANTAGLALSVDGAVLGTVDIAANDSTAFGEYTLNGVYISDGAQVIRVTMAGEGAAIGLDSIAFNYTDNTVYTPENAVLGMGIGINLGNTLDAFPNEGDWAPAAQEYYFKAYKDAGFRHVRIPATWDDHTADTAPYAVNAARMDRTEQIVDWALAQGYFVILNAHHEHWLKENYGNQTYRDRFDAIWQQIAERFKNKSARLMFEILNEPNGMTVADVDDLNPRILDIIRETNPTRLVVFSGNGYTPVDALLAAAIPNDDYLIGNFHSYDPWQFGGQCVRSWGTEQDYTDLENIYKRANTWSEQHDIPVMVNEFGAAHYDFTAPQNVCNQQARLAYLGAHATFAIQYGFGASVWDDGGSFEVYKRGENSWREAKDVLVAPNP

SEQ ID NO: 5 - DNA, 1701 bp, Microbulbifer degradans
atgtttcttttagactttacccgcactgcgtttagctgtacacgaaagcttacctttttgaaatccgcgctacttataagctgctttgccgggcttactgcctgtggtggcgggagtgatggcggtgctgcaagtggctcatcctctagctcgtctagcagcagttcgtctagtagctcttcgagcagttcttcaactagttcctcaagctcctcttcaagctctagttcgtccagttccagctcttcgtctaatagttcctctagctcctctggtggcgatgctttagcgtgccagcatgaaatggcaccagcgctattatctgcaagtgatactaccatggtgcaagcggagtattacgatacctgtgcttcttcggcattagataacaccactggtaacagtggcggtgagttgcgaactgacgatgtagatatagtggccattgcggacggctatgctattacggatatgcagtcaggcgagtacgtagaatattcactaacagtgcaaacttccggtttgtttgacattagttttgcggtacagccgcacgcagctaatactgccggtttggcgctgagtgtagatggcgcagtgttaggcacagttgatattgccgctaatgacagcaccgcatttggcgaatatacgcttaacggcgtgtacataagcgatggcgcgcaagtaataagggtaaccatggccggcgaaggcgctgctattgggttagattccattgcctttaattacaccgataataccgtttacaccccagaaaacgccgtgttgggtatgggaataggtattaacctaggcaataccttagatgccttccccaacgaaggtgactgggcaccggctgcgcaggaatactattttaaagcctacaaggatgcaggtttccgccatgtacgcatcccagcaacttgggatgatcacacggctgatacagccccctacgctgtaaatgcagcacgtatggatcgcactgagcagattgtagattgggccttggcgcagggctatttcgtaattcttaatgcccaccacgaacactggctaaaagaaaactacggcaatcaaacataccgcgatcgctttgatgcaatttggcagcaaattgccgaacgctttaagaataagtcggctcgcttaatgtttgagatactcaatgagccaaacggcatgacagtggccgatgtggatgacctcaacccacgtattctcgatattattcgcgaaaccaatcccacgcgattggtagtgttctctggtaatgggtatacccctgtggatgccttacttgcggctgcaatccctaatgatgattaccttattggtaactttcactcctacgacccttggcagtttggcggtcagtgcgtacgatcgtggggtacagagcaagattacaccgacctagagaacatatataagcgcgcaaatacttggtctgagcagcacgacatacccgttatggtgaacgaatttggcgctgcccattacgattttactgcaccgcagaatgtatgtaaccagcaggctcgtttggcttatttaggtgcccatgccacatttgctattcagtacggctttggcgcaagtgtatgggacgacggtggatcatttgaggtgtacaagcgcggtgaaaatagctggcgcgaagctaaagatgtattagtggcgccaaacccgtag

SEQ ID NO: 6 - protein, 451 aa, Microbulbifer degradans
MRIITAFAVMLLCITGCSGSGASDSPQASNSSSGSSSSSSSSSSSSSSSSSSSSSSTSSSSSSSSSSSSSSSSSSGGEALYPSYNTNPPAPDMTGMTSTATQLADRITVGWNIGNTLEAIGGETNWGNPLVTNELIQAVKASGFDSIRIPAAWDQYANQETAAIDINWLNRVKQVVQYSIDNDMVVVLNIHWDGGWLERNVEPSEQVAVNAKQKAYWEQIATHLRDFDERLIFASANEPHVETEAQMAVLNVYHQTFVDTVRATGGKNAYRVLVLQGPKTDIETTSLLWTQMPQDSAVNKLMAELHFYTPYNFTLMNVDESWGNQFYYWGEGNHSTTDTGRNPTWGEEATVDSLLAITKQQFVDQGIPVIIGEYGAQRRDNLTGDELALHLQSRNYYLKYVTQKCVELGLKPFYWDTGGLDNNQSGLFNRSTYQVFDQNALDAIMEGARGE

SEQ ID NO: 7 - DNA, 1356 bp, Microbulbifer degradans
atgagaataataacggcgtttgcagttatgctgctatgcataacaggctgtagcggatcgggcgcgagtgatagcccgcaagcatccaattcgtcttcgggcagttcttctagctctagcagttcgtcaagttcgagcagttcctctagttcgtcgtctagctcttcaacaagctctagcagctcatctagctccagctcatcatcaagctctagcagttcttcgggcggcgaagcgctttacccaagctacaatacaaacccgccagcgccagatatgaccggcatgacaagtactgccacacaactagcagatcgtataaccgtgggctggaatattggtaacacgctagaggcaataggcggcgaaaccaactggggtaacccgctggttactaacgaattaattcaagcggtaaaagccagtggctttgattccattcgtatacccgccgcgtgggatcaatacgccaaccaagaaacggccgcaatagatataaactggctaaaccgcgttaaacaagttgtgcaatacagcatagataacgacatggtggtagtgctaaacatccactgggatggcggttggctagagcgcaatgtagagcccagcgagcaagtagcagtaaatgcaaaacaaaaagcctattgggaacaaattgccactcacctgcgcgactttgacgagcgcctaatatttgccagcgccaacgaaccccatgtagaaaccgaagcacaaatggccgtactaaacgtataccatcaaacgtttgtagatacagtgcgtgcaactggcggtaaaaatgcttaccgcgtactggtattgcaggggccaaaaacagatatagaaaccacctcgctattgtggacccaaatgccgcaagatagcgccgtaaataaacttatggcagagctacacttctataccccgtacaactttacgttaatgaatgtagatgaaagctggggcaaccagttctactactggggcgaaggtaatcattccactaccgacacaggccgcaacccaacctggggcgaagaagcaacagtagattcactgctggcaattaccaaacaacagtttgtggaccaaggtatacccgtaattattggcgaatacggtgcacaacgccgcgataaccttaccggcgatgaattggccctgcacttacaatcgcgcaactactacttaaaatacgttactcaaaaatgtgtagagctaggcttaaaacctttttattgggataccggcggcttagacaacaatcaatctggcctgtttaatcgcagtacctaccaagtatttgatcaaaatgccctagatgccattatggaaggggccagaggggaataa

SEQ ID NO: 8 - protein, 621 aa, Microbulbifer degradans
MLKHQFSKALRALGFGGAVFAASLMASQASALECEHSISNDWGAGFTGAMKVTNNDSSPITGWRVEWAYSGNVNIVNSWNASVTKGSNYVAVDAGWNGNLQPSQSTEFGLQGDGADRNVTIISCVAEGGSSSSSSSSSSSSSSSSSSSSTSSSSSSSSSTSSSSSSTSSSSSSTSSSSSSSSSSSSSGGNCVAMCNWYGENRPVCANQNTGWGWENNQSCIGANTCNDQWGDGGVVSSCGTSSSSSSSSSSSSTSSSSSSSSSTSSTSSSSSSSSSSGGLSAVEFSQQMGLGWNLGNSLEAIGGETAWGNPMVTQQLINSIKAAGFDTIRIPVAWSQFSDEANFVINSNWIARVEEVVNYALSADMYVVMNQHWDGGWMQPTYAQQEYVNNRLQIMWTQIANHFKDYDSRLLFAGTNEVMVEGDYGTPTFEYYTVQNSFNQTFVDAVRATGGANASRYLVVQGFNTNIDHTVNFAVVPTDPATNRLMMEVHYYDPYNFTLNTNSNITQWGVIATDPSVTETWANESYVDATFQKMKTNFVDQGIAVILGEYGVVSRANVAGHETYREYWNQYITQSAVDHGMVPIYWDNGYSGDGGMALFDRASGNQLYPNIINAIINAGN

SEQ ID NO: 9 - protein, 85 aa, Microbulbifer degradans
MLEEELEVELEEELVEELELLDEEVLELDEELLEELEELDELEDDPPSATQLIMVTFLSAPSPCKPNSVDWLGCKLPFHPASTAT

SEQ ID NO: 10 - DNA, 1866 bp, Microbulbifer degradans
atgttgaaacatcaattcagcaaagcgctgcgtgcgctaggctttggtggggctgtgtttgcggcatcgctaatggctagccaagcaagtgcccttgagtgtgagcattcaatcagtaatgattggggcgccggctttaccggtgcaatgaaagttaccaataatgactctagccccattaccggttggcgggtcgaatgggcgtatagcggcaatgtaaatattgttaattcgtggaacgcctcagtaacaaaaggcagtaattatgttgccgtagatgccggatggaatggtaatttacagccgagccaatctaccgaatttggcttacagggtgatggcgccgatagaaatgtaaccattattagttgtgttgccgaaggcggatcatcttctagttcatcaagttcttccagctcctcaagtagttcttcatctagctcaagtacttcttcatcgagtagctcaagttcctcgacgagctcttcttctagttcgacttctagctcttcttcaagcacctcttctagctcatcgtccagttcatcaagctcttcttcgggcggcaactgtgttgcaatgtgtaattggtacggtgaaaaccgccctgtttgtgccaatcaaaatactggttgggggtgggaaaacaaccaaagctgtataggtgcaaacacctgtaacgatcaatggggcgacgggggcgtggtgtccagctgtggtacgtctagctcttcatccagttcttcgtccagttcgtctaccagttcatcctcgtcttctagctcgagcaccagctctacaagcagctcatcaagctctagttcgtcgtctggtgggttaagcgcggtagagttttcgcagcaaatgggcttggggtggaatcttggaaactccctagaagcgattggtggcgaaaccgcgtggggcaacccaatggttacgcagcaattaattaactccataaaagctgctgggttcgacactattcgcattccggttgcgtggagccaattctcggacgaagctaattttgttatcaatagcaattggattgcacgcgtagaagaagtagtgaactacgcattgagcgccgatatgtacgtggtaatgaaccaacattgggacggcggttggatgcagcccacatatgcacagcaagaatatgttaacaatcgcttgcaaattatgtggacgcaaatagctaatcactttaaagattacgatagtcgcttactgtttgcaggcaccaacgaagtgatggtggaaggcgattacggtacgcccaccttcgaatactacacagtacaaaatagctttaaccaaacgtttgtggatgctgtacgtgcaaccggtggcgctaatgctagccgttacttagtggtacaggggtttaataccaacatagatcacacggtgaacttcgcggtagtgccaaccgacccggcaacaaacaggttaatgatggaagtacactattacgacccctataactttacgttaaataccaacagcaacattactcagtggggcgtaattgcaactgaccctagcgttaccgaaacatgggcgaatgaatcttatgtggatgcgactttccaaaaaatgaaaactaacttcgttgatcaaggtatagcggtaattttaggtgagtacggggttgtatcgcgcgcgaatgtggccgggcacgaaacttaccgagagtattggaaccaatacattactcaatctgcggtagatcatggaatggtgcctatttattgggataacggttattccggtgatggtggtatggcattgtttgatcgcgccagtggcaatcaactttaccccaatattattaacgcaattatcaatgccggtaactaa

SEQ ID NO: 11 - protein, 673 aa, Microbulbifer degradans
MLIGTVTASALVGRGRGTPKKIINKGSIMWQINKSALAAVVLVCSSSSFAQSACDTQRIEAENYVAMSGIQTESTADTGGGLNVGWIDAGDWLSYQVNLPAAGQYEVRYRVASRNGGGVLRLEGNAGQTLYGTMNVPNTGGWQNWQTLSHSVTLAAGEQSIGIGVPSGGFNINWLEFVPLDCSGPIDPPINPPSNCASIVFEAENYDQMSGIRTQTTSDTGGGLNVGWIDAGDWLSYATVNIPSTQVYNFEYRVASPNGGSFNLQGSAGAENFDTATLPNTGGWQNWTTVTGSALLPAGNVNFGISAITGGWNINWFKATPESCDDINPPSTGITAKQAAAAMGKGFNLGQMFESTQHPRTFNAAKSKIDAYYNMGYRNVRIPITWTEAVGGNRLVADANVGAVNRNHSRLAVITQVVDYALSLPGMYVVINAHHEGGLKTNNRWWVLETLWADIADIFKDRDHRLLFEILNEPHLSDANKSPMPPANLRFMTGKAYNKIRAIDAQRIVIIGGNQWFGAGEMANVWPNLNDVGGGSDAYVMATFHHYDPWSFSGDNQGDYADAWTLSNVGNPMDIMQSWANGVGQGMPVYIGEWGVGWGSRYSAMQCNNIRYWYQLFDASYASAKGQPTAVWDDGGWFKIFDHGTNSFNNNLAQCIGGNCAWDGADRFNSGCN

SEQ ID NO: 12 - DNA, 2022 bp, Microbulbifer degradans
atgttgattggtactgttacggcttcagcactggttggtcgaggccgtggcacccctaaaaaaataatcaacaagggttctattatgtggcaaatcaacaaatcggctttagcggccgtggtattagtgtgttcctcatctagctttgcgcaatctgcatgtgacactcaacgcattgaagccgaaaattacgtggcaatgagtggtattcaaaccgaaagcacggcagacactggtggcggtttaaatgtgggctggatagacgccggcgactggcttagttaccaagttaacctacctgctgcagggcagtacgaggtgcgctatcgcgttgccagtagaaatggcggcggtgtacttcggttagagggcaatgccggtcaaaccttgtatggaactatgaatgtacccaacacgggtggctggcaaaattggcaaaccctttctcattcagtgacattagcggcaggagagcagtctattggtattggtgtgccaagcggcgggtttaatattaattggctggagttcgtacctttagattgcagtgggccaatcgacccgcccattaacccaccttcgaactgcgcgagcattgtattcgaggccgaaaattacgatcaaatgagcggcattagaacgcaaaccacaagtgataccggaggcggcttaaatgtggggtggatagatgctggcgactggcttagctatgccactgtgaatatccccagcacgcaggtgtacaattttgaataccgtgtggctagccctaatggcggcagttttaatttgcagggttcggctggcgcagagaattttgataccgctactttgcccaatacgggtggttggcaaaattggacaacggtaacaggctcggcgcttttacctgctggcaatgtgaatttcggtattagtgcgattactggtggctggaatataaactggtttaaagctacaccagagagctgtgatgatataaaccctccaagtaccggtattactgctaagcaagcagcggcagccatgggcaaggggtttaatttggggcaaatgttcgaaagtacgcaacacccaagaacatttaatgctgcaaaaagtaaaatagatgcttactacaatatgggctacagaaatgtgcgcatccctattacttggactgaagccgtaggcggaaacaggcttgttgcagatgcaaatgtaggcgcagtcaatcgcaaccactctcgcttagctgtaattactcaagtagtagattacgcgctttcgctacccggcatgtacgtggttattaatgcgcatcacgaaggtggattaaaaaccaataatcgctggtgggtgttagaaactctgtgggcagatattgccgatatatttaaagacagagatcaccgtttgctatttgaaatattaaacgagccacacctaagcgatgccaataagtcgcctatgccccccgccaatttgcgttttatgacgggcaaagcctataacaaaattcgcgcgatagatgcgcagcgaatcgttattattggtggcaaccagtggtttggtgcaggtgaaatggcaaacgtatggccaaaccttaatgatgttggcggcggttccgatgcatatgtaatggctacttttcaccattacgacccgtggtcgtttagtggcgataaccaaggcgattacgccgatgcttggacgctatctaacgtgggtaacccaatggatataatgcaaagctgggcaaacggcgtaggccaaggtatgcctgtgtatattggcgagtggggcgtaggttggggcagccgctacagcgccatgcagtgcaataatattcgctattggtaccagctgttcgacgcgagctatgcctcggcaaaaggccagcctacggcagtgtgggatgacggcggttggtttaaaatattcgaccacggtaccaacagcttcaataataatttagcccaatgtattggtggaaactgcgcttgggatggcgccgatagatttaattctggctgtaattaa

SEQ ID NO: 13 - protein, 365 aa, Microbulbifer degradans
MRTTKFLALALCLLASASALSANNSAPSNDWWDIPYPSQFDVKSLKTQSFISVKGNKFIDDKGKTFTFRGVNIADTGKLLSQNQWQKSLFEELANNWGVNTIRLPIHPVSWRKLGPDVYLGHIDEAVRWANDLGIYLILDWHSIGYLPTEQYQHPMYDTTIKETRDFWRRITFRYKNVPTVAVYELFNEPTTMGNTLGERNWAEWKTLNESLIDMIYASDKTVIPLVAGFNWAYDLSPIKKAPIEREGIAYAAHPYPQKAKPEVKNDKNFFKLWDEKWGFAADTYPVIATELGWVQPDGYGAHIPVKDDGSYGPRIVKYMQKKGVSYTVWVFDPDWSPTMINDWDFTPSEQGAFFKQVMLEAKKR

SEQ ID NO: 14 - DNA, 1098 bp, Microbulbifer degradans
atgcgcacaaccaaatttcttgcgcttgcactctgcttgctggcctcagccagtgcactgagtgcaaataacagcgccccatcaaacgactggtgggatataccctacccgagccaattcgatgtaaaaagccttaaaacgcaaagttttatatcggtaaaaggtaacaagttcattgatgataagggcaaaaccttcacttttagaggggtaaacattgccgatacaggtaagctacttagccaaaatcaatggcaaaaatcgctgtttgaagagctggctaataactggggggtaaatactattcgcctgcctattcaccctgtaagttggcgtaaacttgggccagacgtttatttaggccacatcgatgaggcggtacgctgggcgaatgatttaggtatttaccttattcttgattggcactccattggctatttgcccaccgagcaataccaacaccccatgtacgacaccaccattaaagaaacccgcgacttttggcgcagaattacgttccgctacaaaaacgtgcccaccgtagcggtatacgaattatttaatgagccaaccaccatgggtaacaccctaggcgaacgcaactgggccgagtggaaaaccttaaatgaaagcctaattgatatgatatatgccagtgacaaaaccgtcattccgctggttgcaggcttcaactgggcctatgatttatcgccaatcaaaaaggcacctatcgagcgtgaaggcattgcttacgccgcacacccctacccgcaaaaggcgaaaccagaggttaagaacgataaaaacttcttcaaactgtgggacgaaaagtggggctttgctgcagacacctaccctgtaatagcaacagagctaggctgggtacaacccgatggttatggtgcccacatacccgttaaagacgacggcagttacggcccccgcatagtgaagtatatgcagaaaaaaggcgtttcttacacggtatgggtattcgaccccgactggagcccaacaatgattaacgactgggattttacccccagcgagcaaggcgcgttttttaaacaggttatgctagaagctaaaaaacgctaa

SEQ ID NO: 15 - protein, 638 aa, Microbulbifer degradans
MTFTRMKSSHQGACRPRSSTLQRLIASSLTTACLLAASTFADVAPLTVDGNRILSGGQEASFAGNSLFWSNNYWGGEKYYTAETVNWLKQDWGATLVRAAMGVEDNGGYLDDKEGNKQKVKTVVDAAIANDMYVIIDWHSHHAEDHKSEAIAFFEDMARTYGNKKHVIYEIYNEPLQISWSNTIKPYAEDVIRAIRAIDPDNLIIVGTPTWSQDVDVASQDPITGYANIAYTLHFYAGTHKQSLRDKAQTALNNGIALFATEWGTVNANGDGAVNTTETDKWMTFFKTNHISHANWALNDKSEGASALNPGASPNGNWSNADLTTSGKYVKNIIKNWNDGTPGGSSSSSSGGSTSSSSSSSSSNSSSGAGKVNLPARIEAENYNSAPVETTAGNSGGSVSQCTYRGLNVDVQDASEGTCNIGWTAAGEKVTYNIGTANNTYNIALRTASLDAGKRVSVYVGNTLADTISTQGGGWQNWKTQTIPNVYIPSNSVITVEFYDGRTNLNYLNISAASGSSSSSSSSSSSTSSSSSSSSSSSSGGGSCSSYIDIPWNTRTEVTLTSGACVRFNQNLSGKTLQVWDSDANSSCDFRGTVTTVGGTGSLNVSSNYVSSKSLTGTKLTFNSASNNNCKYVKVRAY

SEQ ID NO: 16 - DNA, 1917 bp, Microbulbifer degradans
atgactttcacaagaatgaaatcatcacaccaaggcgcgtgtcgaccaaggtcttccaccctacagcgactaatcgcctcatcacttaccaccgcatgtttgctagcagcgtctacttttgccgacgtagcgccgttaaccgtagatggcaaccgcattctcagcggtggccaagaggctagctttgccggtaacagtttgttttggagcaacaattattggggcggtgagaaatactacacagccgaaactgttaactggttaaaacaagactggggcgcaacactagtgcgcgcggccatgggtgtagaagataacggcggctacctagatgacaaagaaggcaacaaacaaaaggtaaaaaccgttgtagatgctgctattgccaacgacatgtatgtaattatcgattggcacagccaccacgccgaagaccacaaaagtgaagccattgctttttttgaggatatggcgcgcacctacggcaataaaaaacacgttatttacgaaatttataacgagcctttacaaatttcgtggagcaacacaattaaaccctacgccgaagatgtaattagagctattcgcgcgatagaccccgacaacttaattattgttggtacgccaacgtggtcgcaagatgtagacgtagcatcgcaagaccccattaccggctacgccaatattgcctacacattgcacttttacgcaggcacccacaaacaatctttacgagacaaagcgcaaaccgcacttaacaacggcatagcgcttttcgcaacagagtggggaacagtaaatgcaaacggtgatggcgctgtaaacaccaccgaaacagacaagtggatgacgttctttaaaaccaaccacataagccacgcaaactgggcgctaaacgacaaatcagaaggcgcttctgcattaaaccccggagccagccccaatggcaactggagcaacgccgacttaaccacatcgggtaagtacgtaaaaaacattatcaaaaactggaacgacggcacgccgggaggcagctcttcaagctcgtccggcggctcaaccagttcctcctcaagctcatctagctctaattccagctctggtgctggcaaagtaaatttacccgcacgcattgaagccgaaaactataacagtgcaccggtagaaacaactgcaggcaatagtggcggcagcgtttcacaatgtacatacagagggctaaatgtagacgtacaagacgcaagcgaaggcacttgtaatattggctggacagcagcaggcgaaaaagttacctacaacataggcacagcaaataatacttacaatattgcacttcgcaccgcatcgcttgatgcaggcaagcgcgtatcggtatatgtaggcaacaccctcgccgacacaataagcacccaaggtggcggctggcaaaattggaagacgcaaaccatccccaatgtatatattccatcaaactcagttattaccgtggaattctacgatggccgcaccaaccttaactacttaaacattagtgcagcttcggggtcttcctcttcaagctcctcatctagctcgtcaacgtctagctcttcttcgagctcatcttctagctcttcaggtggtggcagttgtagcagctatatagatataccttggaatactcgcaccgaagttaccctaacaagtggcgcctgcgttcgctttaaccaaaacctttcgggcaaaaccctacaagtgtgggatagcgatgcaaactcatcgtgcgatttccggggcacagttacaacagtaggcggcactggcagtttaaatgtaagcagcaactatgtttcgtctaagagcctaacaggaaccaaacttacatttaattcagcaagtaataacaattgtaagtacgttaaagttcgtgcttattag

SEQ ID NO: 17 - protein, 630 aa, Microbulbifer degradans
MKSATTNQSRARSSAFKNMLAASLAGLGLLSASAFADVAPLTVDGNKILSGGQQASFAGNSLFWSNNGWGGEKYYTAGTVEWLKQDWGSNLVRAAMGVDENGGYLEDPAGNKAKVTTVVDAAIANDMYVIIDWHSHHAEDYQNQAISFFQDMARTYGNNNNVIYEIYNEPLQVSWSGTIKPYAEAVIGAIRAIDPDNLIIVGTPTWSQDVDVASRDPITQYSNIAYTIHFYAGTHKQSLRDKAQTALNNGIALFATEWGTVNANGDGGVDAAETDRWMQFFKANHISHANWALNDKAEGSSALKPGSNANGGWSNSDLTASGTYVKNLIKTWNDGSPSSSSSSSTSSSSSSSSSSSSSSSSSSSSSSGGTNLPARIEAENYDSAPVETTAGNSGSPTNCSYKGMGVDVENSTEGACNIGWTAAGEKVTYNIGNADGTYDIALRVASMDAGKRISVHVNNSLADTVTTQGGGWQAWTTETISNVYIPSNSVITVEFYDSGSNLNFLNITESSGTEPPVEPPVEPPVEPPVDNGNFPCNDGNSTLANNGASINLNQGACVKYNHGWGDIRLGTWSGNGTIRYDVLDCNNNVMSDIAQKLNDFTAVDTATMNCAHYIYVKQAPSSYTLQFGSW

SEQ ID NO: 18 - DNA, 1893 bp, Microbulbifer degradans
atgaaatcagcaaccacaaatcaatcgagggcacgcagtagcgcctttaaaaatatgttggcggcatcgctcgcaggtttagggctactatcagcttctgcatttgccgatgtagccccgctaaccgtagacggcaataaaattcttagcggtggccagcaagccagttttgccggtaatagcttattttggtctaacaatggctggggcggtgagaagtattacacggccggtaccgttgaatggctaaagcaagactggggcagtaatttagttcgcgccgcaatgggtgtcgatgaaaacggcggctacttagaagacccagcaggaaacaaagcgaaagtaacaaccgttgtagatgcagccatcgctaacgatatgtatgtaattatcgattggcacagccaccacgccgaagactaccaaaaccaagccattagctttttccaagatatggctcgcacctacggtaacaacaacaacgttatatacgaaatttataacgagccattacaggtttcttggagcggcaccatcaagccttacgcagaagcggtaattggcgcaattcgcgcaatcgacccagataaccttattattgtgggcacgcctacttggtcgcaggatgtagacgtagcctcgcgcgaccccatcacgcagtacagcaacattgcctacactattcacttttatgcgggcacccacaaacaatccctacgcgataaagcacaaaccgcattaaataatggtattgctttgtttgctaccgaatggggtacagtaaatgccaacggtgacggcggtgtagacgcagccgaaactgatcgttggatgcagttttttaaagcgaatcatataagccatgccaactgggccttaaacgataaagccgaaggctcttctgcattaaagcctggctctaacgcaaacggcggctggagcaattccgacttaaccgcctctggtacctatgttaaaaacttaattaaaacatggaacgacggctcaccgagcagcagctcatctagcagcaccagttcttcttcaagcagctcctcgtctagtagctcatcatctagcagctcttcatctagtagttctggcggtaccaatttacccgcgcgcattgaagcagaaaactacgatagcgcaccggtagaaaccactgcaggtaatagcggctcacccaccaattgttcgtataaaggtatgggcgtagatgtagaaaactctactgaaggtgcttgtaatattggctggactgcggcaggcgaaaaagtaacttacaacattggcaatgccgatggcacttacgatattgcattgcgcgtagcctctatggatgcgggcaaacgtatctctgtgcatgtaaacaacagcctagcagataccgtaaccacacaaggtggcggctggcaggcatggactaccgaaaccatttctaacgtgtatatcccatcaaactcggtaattaccgttgagttttacgatagtggctctaacctaaactttttaaacattaccgaaagctcgggtaccgaaccacctgtagaaccacccgttgagccgccagtagaaccacccgtagacaacggtaacttcccatgtaacgacggtaactctacgcttgccaacaacggcgcctccattaaccttaaccaaggagcgtgtgttaaatacaatcacggctggggcgatattcgtttaggcacctggagcggcaacggtaccattcgatacgacgtactagactgcaataacaacgtaatgagtgatattgcacaaaaacttaatgactttactgctgtagacaccgcaacaatgaactgcgcacactacatttatgtaaaacaagcccctagcagctacaccctgcaatttggtagctggtag

SEQ ID NO: 19 - protein, 725 aa, Microbulbifer degradans
MKINTLFTPLRTVGAAVAIALSPVAFADVTCEVTNFNQWNSGYQADVRVTNSGSAVSGWTVNLNFASAPQMTNGWNAALSTSGNTISASNISWNGNLGNGQSTSFGFQGNSNGNLATPTCVGSGTGSSSSSSSSSTSSTSSSSTSSSSTSSTSSSSSSSGGECVEMCKWYQDAPRPLCNNQDSGWGWENNQSCIGRTTCNSQSGNGGVINSCPSSSSSSSSSSTSSTSSSSTSSTSSSSTSSTSSTSSSSTSSTSSSSTSSTSSSSSSGGGVFRVDATGNITKNGEVLPVRCGNWFGLEGQHEPSDAQNNPGGAPLELYVGNMWWVDSGRTIQQTMSEITAQGINMVRLPIAPQTLNPNDPQGVGDVRNGGVLKNHESVQQTNARQALEDFIVQANENDIQVLIDIHSCSNYVGWRAGRLDAEPPYVDATRVGYDFTREDYSCGTNVGPGVTVHEYNEEIWLNNLREIAGLSESLGVDNIIGIDIFNEPWDYTWEEWKALSESAYQAISEVNPDILIFVEGVAGGTGAGVDVPHGDESSNPNWGENFYPAQTAPLNIPKDRLVISPHTYGPSVFVQRQFMDPNDPECVGLEGDEAAEAGCQIVIDYATLAAGWDEHFGFLREQGFAMVVGEFGGNMDWPNGTRQAEKDMWSHITPGIDRQWQEAFVDYMVEKNIQACYWSINPESGDTGGWYGHEYDPVSNDAGWGRWLDFDSRKTNLLKELWGI

SEQ ID NO: 20 - protein, 71 aa, Microbulbifer degradans
MLEVELLLVELVELDEVLEVLLVELDEVLEVLDELVDEVLEELEELEELGQLLITPPLPDWLLQVVRPIQL

SEQ ID NO: 21 - DNA, 2178 bp, Microbulbifer degradans
atgaaaatcaacactctctttacgcctttgcgtactgtgggtgctgcagttgcgatagctttatcgcctgtagcctttgcagacgtaacgtgcgaagtaacgaactttaaccagtggaatagtggctaccaagccgatgttcgtgttacaaacagcggtagcgctgttagtggctggaccgtaaatttaaattttgcctcagccccgcaaatgacaaatggctggaacgcagctttgagtactagcggcaatacaattagtgcatctaatattagttggaatggcaatttgggtaatggtcagtccaccagctttggttttcagggcaattcaaatggtaacttggcaacgccaacgtgtgtaggtagcggtacggggtcttctagcagctcttcatccagctctacttctagcacaagctcatcatctacaagttcttctagcacgtcttctactagctctagcagttcatcctctggtggtgaatgtgtagaaatgtgtaagtggtatcaagatgcaccgcgcccattatgtaataatcaagacagtggttggggttgggaaaacaatcaaagctgtattggtcgcactacttgtaacagccaatctggcaatggtggtgtaattaatagttgcccaagttcttcaagttcttcaagttcttctagcacttcgtctaccagctcatctagtacttcaagtacttcatcgagctcaacaagtagtacttcaagcacttcatcaagttccacaagctctactagcagcagctcaacctctagcactagctcgtcgtcttcaagtggtggtggagtattccgcgtagatgctaccggtaatattactaaaaatggtgaagtactgcctgttcgttgtggtaactggtttggtctagagggccagcacgagccttcagatgcgcaaaataacccaggcggtgcgccgcttgaattatatgttggcaacatgtggtgggtagatagtggccgcactattcagcaaaccatgagcgaaattaccgcccaaggtatcaacatggttcgcttgcctattgcaccgcaaacattaaaccctaacgaccctcaaggtgtgggtgatgtgcgcaacggcggcgtgcttaaaaatcacgaatctgtgcagcaaaccaatgcacgtcaagcgttagaagacttcattgttcaagctaacgaaaatgacattcaagtgctaattgatattcactcttgtagtaactacgtgggttggcgtgcaggccgtttagatgcagagcctccttatgtggatgcaacgcgagtgggttatgactttacccgtgaagattattcttgtggcaccaatgtgggcccaggtgtaactgtgcacgagtacaacgaggaaatttggttaaacaacttgcgtgagattgctggtttatctgaatccttgggcgttgataatattatcggtatcgatatttttaacgaaccatgggattacacttgggaagagtggaaagcactttctgaaagcgcttatcaagccattagcgaagttaacccagatattctaatctttgttgagggtgttgcaggcggcacgggtgctggtgttgatgtgccacatggagacgagtcttctaaccctaactggggcgaaaacttttatcctgcgcaaactgctccgcttaatattccaaaagatcgtctagttatttcaccgcatacctatggcccatctgtatttgttcagcgtcaatttatggacccgaatgatccagagtgtgttggtttagaaggtgatgaggcggctgaagctggctgtcaaattgttatcgattatgcaaccttagcagctggttgggatgagcatttcggcttcttacgtgagcaaggctttgccatggtagtgggtgagtttggtggcaacatggattggccaaatggcacgcgccaagcagaaaaagatatgtggagccacatcacccctggaatcgacagacagtggcaagaagcgtttgttgactacatggttgagaaaaacatccaagcttgttactggtcaattaacccagagtctggcgacactggcggttggtatggtcacgagtacgaccctgtttctaacgatgcaggttgggggcgttggttagacttcgattctcgcaaaactaacttacttaaagagctttggggtatttaa

SEQ ID NO: 22 - protein, 610 aa, Microbulbifer degradans
MMYTNLFNLKKHLFQTSLKLLACATLIGGTLNAAADVPAMSVQGNKVLVGGEVKSLGGMSYFWSNNGWGGEKYYNASTVSYFKQDWKASIVRAAMGVEDAGGYFDDPQGSKQKVRTIVDAAIANDMYVIIDWHSHYANTHDWAAAVQFFQEMARDYGQYNNVIYEVYNEPLDIPWGHIKSYAETVIDAIRAIDPDNVIVVGTPRWSQGVKEASWDPINRNNIAYTLHFYSGSHGQWLRNDAAEAMSNGIALFVTEWGSVNANGDGAVNEGETAAWMNFMRDNGIHHANWSVNDKAEGASALNPGASATGGWGDGDLTWSGHVVRGYLRDWNQIGSGNGNGNGTGCTEVSLPGTIEAEAYCAMDGIQTENTNDTNGGSNVGYIDAGDWMSYSVNVANAGTYTVSYRVASLGGGGVLSIENAGGSPVYGTLNVPQTGGWQEWTTVSHDISLQAGQQNIGIAAIEGGFNINWIALTPAGTNPNPVQSITLQAEDYSFMSGVQVENTSDNGGGMNVGWLDAGDWLAYHGVNIPTSGQYTITYRVASQSGGGSLQLEQAGGGVVYGNLNVPSTGGWQNWVDVSHTVTLNAGVQDFGLGITSGGFNINWIKVEAIH

SEQ ID NO: 23 - DNA, 1833 bp, Microbulbifer degradans
atgatgtacacaaacctctttaatttaaaaaagcacctctttcaaacctcacttaaactactggcctgcgccacattaattggcggcaccctaaacgcagccgctgacgtgccagcaatgtccgtacaaggcaataaagtactggtgggcggtgaagttaaaagccttggaggtatgagctatttttggtctaacaacggctggggcggcgagaaatactacaacgcttctaccgttagttacttcaagcaagactggaaggcatccattgttcgagctgcaatgggggtagaagatgccggcggctacttcgatgacccgcagggctctaagcaaaaagttcgtacaatagtagatgccgccattgcgaatgatatgtacgtcattatcgattggcactcacattacgccaacacccacgactgggcagccgctgtgcaatttttccaagaaatggcacgtgactatggccaatacaataatgtgatttatgaggtatacaacgaaccactggatatcccttggggccacataaaaagctacgccgaaacggtaattgatgccattcgcgcaattgacccagataacgtgatcgtagtaggcactcctcgctggtcgcagggggtaaaagaagcgtcatgggacccaatcaaccgcaataatattgcctacacgctgcacttctattcaggtagtcatggccaatggctgcgcaacgacgcagcagaagctatgagtaatggtattgccttgtttgttactgaatggggcagcgtaaatgccaatggcgatggcgcagtcaacgaaggcgaaaccgcagcgtggatgaacttcatgcgcgataacggtatccatcacgcaaactggtctgtaaacgacaaagcagagggtgcatctgcacttaaccctggcgccagtgccacaggtggttggggcgacggcgatttgacttggtctggccatgttgtgcgcggctacctgcgcgactggaaccaaattggttctggcaatggtaacggcaacggcacaggctgcaccgaggttagcctaccaggcacgatagaagcggaagcctactgcgcaatggatggtatccaaaccgaaaacaccaacgacaccaacggcggcagtaacgtgggctacatagatgctggcgactggatgagctacagcgtaaacgttgctaacgcaggcacttataccgtgtcttaccgcgtggctagccttggcggcggcggtgttctaagcattgaaaatgccggcggctcgcccgtttatggcacgctgaatgtaccgcaaactggcggctggcaagaatggaccactgtatctcacgatattagcttgcaagccggccaacaaaacattggcatagcggcaatagaaggtggttttaacatcaactggatagccctaacccctgctggcaccaaccccaacccagtgcaaagtattaccttacaagcagaagactactcctttatgagtggcgtgcaggtagaaaatactagcgacaatggcggcggtatgaacgtaggctggttagatgctggcgactggcttgcctaccacggcgtaaacattccaacctctggccaatacaccataacttaccgagtagccagccaaagcggtggtggaagcctgcagctagaacaagcaggtggcggcgttgtttacggtaacctgaacgtaccaagcactggcggctggcagaactgggtagacgtaagccataccgttacccttaacgctggtgtacaagattttgggttaggtattactagtggtggcttcaatattaactggataaaagtcgaggcaattcactaa

SEQ ID NO: 24 - protein, 791 aa, Microbulbifer degradans
MLASNKNSKLANSEQHRPYKTRTARWLTGSGVIASSLLFSAQSFAAQCEYIISNEWNSGFTGAVRITNNGTTPINGWDVSWQYAGDAVTSSWNANVSGSNPVSATPLSWNANIQPGQSVEFGFQGSKAGSNAEIPTVTGAVCDSGSSSSSSSSSSSSSSSSSSSSSTSSSSSSSSSTSSSSSSSGSSGTGGIACTVGNANIWGSGYQLDMQVVNNGTAAVSSWDVTMAFGEAPQRTGGWNANFVESGNTIVASNISWNGNLAPGQSASFGIQGNHDGSFGGVTCNGASSSGSSSSGSSTSSSSSSSSSSGSSTSSSSSSSSTGSTSSSSSSSTSSTSSSSSSSTSSTSSSSSSSSSTSSSSSSSSSSSSSSTSGSGAGFDNPFIGGKWYVDPVWSAKAAAEPNGSLIANYNTAVWMDRIGAIEGPEDGDGMGLEEHLDEALAQGADIFMFVVYDLPNRDCAALASSGELLIAENGFERYQNEYIGPIVDILSKPAYSSLRIIAIIEVDSLPNLVTNLNIQKCVEANGPGGYVDGIQHALNELNTLDNVYPYVDIAHSGWLGWSDNFAGATKLIGDAIKGTNKGVNSIAGFVSNSSNYTPVTEPYLPNPTLQIGSNQVRSADFYEWTMYFEELSFVQDWRQAMIQQGFPESIGMLIDTARNGWGGPDRPTGESTSTDLNTYVNESRIDRRQHRGNWCNQPGGVGFRPQAAPEPGVDAYVWVKPQGESDGISDPNFPIDPNDPAKQHDPMCDPNAPNRDNNAVGTGALDNAPHAGRWFPEAFQILIENAYPPL

SEQ ID NO: 25 - protein, 65 aa, Microbulbifer degradans
MPLEPDDELDEEVLEELDEELLVLLELLEELDELDDELELEELEPLSHTAPVTVGISALEPALLP

SEQ ID NO: 26 - protein, 112 aa, Microbulbifer degradans
MNGLSKPAPLPEVEELELEEDELELDDVLELELELELVELVLELELEEVLEVEELLELEVEPVEELELELEVLEPDELDELLDELVLEPELDEPELEAPLQVTPPKEPSWFP

SEQ ID NO: 27 - DNA, 2376 bp, Microbulbifer degradans
atgttggcttctaataaaaatagtaagctggcaaactctgagcaacaccgcccttataaaacccgcacagcgcgctggttaaccgggtctggggttattgcttcaagtttgcttttttctgcgcagagttttgcggcgcaatgtgaatacatcattagcaatgaatggaacagcggctttactggcgcagttcgcattactaataatggcactactcccatcaatggctgggatgttagctggcagtatgccggcgatgcagtcaccagcagctggaacgcgaatgtttctggctcgaaccccgtttctgctacaccattaagctggaatgccaacattcaacccggtcaaagcgttgagtttggttttcagggcagcaaagccggctccaatgcagaaattccaaccgttaccggcgcggtatgtgatagcggctctagctcttccagctccagctcatcatctagttcatcaagctcttctagtagctcaagcagcactagcagctcctcgtccagctcttcaagcacctcttcgtctagctcatcatctggctccagtggcacaggtggtattgcgtgtactgtaggcaatgcgaatatttggggctcgggctaccagctggacatgcaagttgttaacaacggcaccgctgcagtaagcagttgggacgtaaccatggcattcggcgaggcaccacagcgcaccggtggctggaacgcaaactttgtagagtcaggcaataccattgttgcgagcaacattagctggaacggcaacctcgcaccggggcaatcagcttcgtttggtattcaagggaaccacgacggctcttttggcggcgtaacctgtaacggcgcttcaagctctggctcgtctagttctggctctagcaccagctcatcaagtagctcatccagttcgtctggctctagcacttctagctctagctcaagctcctctactggttctacctctagctctagtagctcttcaacttctagcacttcttcaagttctagctctagcaccagctccacgagttctagctccagttctagctcgagtacatcgtctagttccagctcatcttcctcaagctctagctcttctacttcaggcagtggcgcaggttttgacaacccgttcattggcggcaagtggtatgtagacccagtatggtcagcaaaagctgcagcagagccaaacggttcacttattgccaactacaacacggcagtttggatggatcgcattggtgcgattgaaggcccagaagatggcgatggtatgggcttagaagaacacttagatgaagctttagcacaaggtgcagacatctttatgttcgtggtatacgacctaccaaaccgcgactgtgcagctttggcctcaagtggcgaactactcattgccgagaacggttttgagcgctatcaaaatgagtacattggcccaatcgtagatatactcagcaagcccgcgtattctagcttgcgtattatcgcgattattgaagtggattctctacccaacctcgttaccaacctcaacattcaaaaatgtgttgaagcgaatggcccgggtgggtacgtagacggtatccaacatgcacttaacgagctaaacacgcttgataatgtgtacccatacgtcgatattgctcactcaggctggctaggctggagcgacaacttcgccggcgccaccaagcttattggtgatgcaattaaaggcacaaacaaaggtgtaaacagtattgcaggctttgtaagtaactcttctaactacacacctgtgactgaaccatacctacctaaccctaccttgcaaattggtagcaaccaagttcgatctgcggatttctacgagtggaccatgtacttcgaagaacttagctttgtacaagattggcgccaagccatgattcagcaaggcttcccagaatcaattggtatgcttattgataccgcacgtaatggctggggtggacctgaccgtccaactggtgagtctacatctaccgacctcaacacctatgtgaatgaatcgcgtatagaccgccgtcagcatcgcggaaactggtgtaaccagcccggtggtgttggcttccgtccgcaagcggcaccagaaccaggtgtagacgcttacgtttgggttaagccacaaggtgagtcggatggtattagtgatcctaacttccctatcgaccctaacgacccagctaaacagcacgacccaatgtgtgatccaaacgcacctaaccgcgataacaatgcggttggcacaggcgcgctagataacgctccacatgctggtcgctggttcccagaagcattccaaatacttatagaaaacgcctacccaccgctatag

SEQ ID NO: 28 - protein, 578 aa, Microbulbifer degradans
MNKVKVLALCASVAVMIGCSDADTKLANSAKAEVGFTKVNQLGYLPAAKKLAVVPAVAAAKFDIIDVTSGKVAFTGSLSDVKSWSAMGDESFKLADFSALQAEGSYRLVVQGVSDSYTFDISPSVYSQAHDGALKAYYYNRASTELTEQYAGVYARPAGHPDTDVRIFDNAASAARPADTSFAAPKGWYDAGDYGKYIVNSGISTYTLMAAYEHFPSFYKQRDIDIPESGDAVPDILDEVMWNLEWMQVMQDPNDGGVYHKLTTLNFSGAVMPHEATAQRYFIKKSTAATLDFAAVMATASRVYAPFEGAFPGKSAAYRQAAIAAWEWAQANPSETYSQTPLSKVQTGAYGDKKLNDEFAWAAAELFILTGEQKYWQAFNKQKVQAGESSWANVAGLGFISLANNARSLLNEAQYKTVTDSIVRAADSLLVTYKENAYQVPIGNKDFFWGGNSGTLNRAWVLLEANKIKPQQEYIDAALAAVDYIYGRNPTNYSFVTGFGDNPAVGIHHRPSYADGIKAPVPGWLAGGAHNGKQDGCEYPSDAPAKSYLDDWCSYSTNEIAINWNAPLVYILAAVNNL

SEQ ID NO: 29 - DNA, 1737 bp, Microbulbifer degradans
atgaacaaagttaaagttttagcgctgtgtgccagtgtggctgtaatgataggttgcagtgatgccgacactaaattagctaactcggccaaggccgaggtgggctttaccaaagtgaatcagctgggttatttgcccgcggccaaaaagctggcggtggtacccgccgttgcagctgcaaaattcgacataatcgatgtaactagcggtaaagtagcgtttacggggagtttaagcgacgtaaaaagctggagcgcgatgggggacgaatctttcaagttggcagactttagcgccctgcaagccgaagggagttaccgcttagttgttcagggtgtgagtgattcttacaccttcgatattagcccaagtgtatatagccaagcgcacgatggagcccttaaagcctattactataatcgagcgagcacagagttaacagaacagtacgccggggtgtatgcgcgacctgcggggcacccagataccgacgtacgcatattcgataacgccgcctcagccgcgcgcccagcagatacaagctttgctgcaccaaagggttggtacgatgctggcgattacggcaagtacattgttaacagtggtatttccacttacaccctaatggctgcgtacgagcatttcccgtcgttttacaagcaacgcgatatagatattcccgaatctggcgatgccgtaccggatattctcgacgaggtaatgtggaaccttgaatggatgcaggtcatgcaagacccgaacgacggcggtgtgtaccacaagcttaccaccctgaatttttctggcgcagtcatgccgcacgaagcgactgcgcagcgctattttattaaaaaatctaccgctgcaacgctagattttgccgcggttatggccactgcaagccgagtatacgcaccgttcgaaggtgcttttcctggtaaatcagctgcttatcgacaggcggccattgctgcgtgggagtgggcacaagcaaaccctagtgagacatattcgcagacaccgctgagcaaagttcaaaccggcgcctatggtgataaaaagttaaacgatgaatttgcgtgggcggccgcagagttgtttatattgaccggcgagcaaaaatactggcaggcgtttaacaagcaaaaagtgcaggcgggtgagtctagctgggcgaatgttgcggggttggggtttatttccttggccaataatgcgcgcagcctgttaaacgaagctcaatacaaaaccgttaccgattcaattgttcgcgctgcagatagcttgcttgttacttacaaagagaatgcctaccaagtacccattggcaacaaagattttttctggggtggcaattccggcacgttaaatcgcgcttgggttttgcttgaggccaataaaattaaaccgcagcaagaatacatcgatgctgcacttgccgcggtggattatatttatggtcgcaaccctaccaactactcttttgtcactgggtttggcgataaccctgcggtgggtatccatcatcgtccatcctatgccgatggcattaaagcccctgtgcctggttggcttgcgggcggtgcgcacaatggcaagcaagatggttgtgagtacccttccgatgcaccggcaaaatcctatctagacgactggtgcagttactccaccaacgaaattgctattaattggaatgcgccgttagtttacatactggctgcggtaaataatttgtag

SEQ ID NO: 30 - protein, 867 aa, Microbulbifer degradans
MNLTSIMFEQSVKKVAKSAIAVAVASAVTLSAAQAEVGNPRVNQVGYIPNGAKVASYVAPSNTAQTWQLLRNGSVVASGTTTPKGTDAASGDNIHHIDFSAVSATGEGFSLLVGGDESYPFEISADAFTPVLYDSIRYFYHNRSGIAIETQYTGGGNGSYAANAQWARPAGHINQNANQGDNAVPCWSGSGCNYALDVTKGWYDAGDHGKYVVNGGISVWKLLNMYERALHISGSQNKYADGTLNIPESGNGVADILDEARWQMEFLLAMQVPEGEAKAGMVHHKMHDVGWTGLPLAPHEDNRERALVPPSVTATLNVAATGAQCARLFDEIDASFAASCLTAAERAWDAALQNPNDVYTGGYDNGGGGYGDEVADDEFFWAAAELYITTGDSKYLSTINNYNVTRIDWGWPDTELPALMSLAVVPANHTANLRATARAKIVEIADTHVATSNAAGYLTPSSALDYYWGSNNGVANKIALLGLAYDFTGDDVYAKTVSKAVNYLFGNNTLSFSYISGHGENALQQPHHRFWAGALNGSYPWLPPGALSGGPNAGLEDGVAAAALSACVSTPAKCYMDDIESWSTNEITINWNGALVWAMAFYDDYADSGSGSSSSSSSSSSSSSSSSSSSTSSSSSSSSSSSSSGSSSSSSSSTSSSSSSSSSGGECVEMCKWYQDAPRPLCNNQNSGWGWENQQSCIGRTTCESQSGNGGVINSCGTSSSSSSSSSSSSSSSSSSSSSSSSTSSSSSSSSSSSSSSTSSSSSSSSGGVAGVACAVTKMNHWGSGYQLDVTVSNNGAAAVSGWSIELDFGESPQLTGSWNAAVSASGNTVSATNISWNGNLSAGQSTSFGMQGNSDGSLSTPSCLVK

SEQ ID NO: 31 - protein, 49 aa, Microbulbifer degradans
MEELLEELEPLDEELLLEDDELEVELEELDEELDELEELDELEPLPESA

SEQ ID NO: 32 - DNA, 2604 bp, Microbulbifer degradans
atgaatcttacttcaatcatgtttgaacaatcagtaaaaaaagtcgctaagtcagccattgccgtggcagttgcttcggcggttaccttaagtgcggcgcaggccgaggtgggtaacccacgtgttaaccaagtaggctatatacccaatggtgccaaagttgccagttatgttgcgccatcaaatacggcacaaacgtggcagttactgcgtaatggcagtgtggttgcaagtggcactacaaccccaaagggtacagatgcagcctcgggtgacaatattcaccatatcgatttttctgcggtgagtgcaaccggcgaaggttttagtttgcttgtgggcggcgatgaaagttacccctttgaaatttctgccgacgcatttacaccggttttatacgattccatccgttacttttatcacaaccgttcgggtatcgcgattgaaacgcagtacaccggtggcggtaacggtagctacgcggcgaatgctcagtgggctaggcccgcaggtcacattaatcaaaatgctaaccaaggcgataatgcggtgccgtgttggtcgggcagtggttgcaactacgccttagacgtaactaaaggttggtacgatgccggtgaccacggtaaatatgttgtaaacggtggcatttccgtatggaagctattaaacatgtacgagcgtgccttgcacattagtggcagccaaaataaatacgccgacggtacattaaatattcctgaaagcggcaatggcgtggcggatattttggatgaagctcgctggcaaatggagtttttattagccatgcaagtgccagagggcgaagcgaaagctggcatggtgcaccacaaaatgcacgatgtgggttggacaggcttgccactagcaccccatgaagataatcgcgagcgcgcgcttgtgccgccttcggttactgcaacccttaacgttgcggccacaggcgcgcagtgtgcgcgtttatttgacgaaatagatgcgagttttgcagcaagttgtttaactgccgcagagcgcgcatgggatgcagccctgcaaaaccctaacgatgtttacactggcggctacgataatggcggcggtggttacggcgatgaagtggcggacgacgagtttttctgggctgctgctgagttatacattaccactggcgatagcaaatatctttcaaccattaacaactacaatgtaacgcgcattgattggggctggccagataccgagttgcctgcgttgatgtcgttagcggttgtgcctgctaatcacaccgcaaatttgcgtgcgactgctcgtgcaaaaattgtagaaattgcagatacccatgtcgctaccagtaatgctgccggctatttaacaccatcgtccgcgctggattactactggggttctaacaatggcgtagccaataaaattgcgttacttggtttggcatacgattttactggcgatgacgtttacgcgaaaacggtgtcgaaagcagttaactatttatttggtaataataccttatcgttttcttatatttctgggcatggcgaaaatgctttgcaacagccgcatcaccgcttttgggctggggcattaaatggaagttacccatggttgccgcctggtgcgctttctggtggccctaacgcagggttagaagatggcgttgccgccgccgcgctaagtgcttgtgtttcaacgcctgccaaatgctatatggatgatattgaatcttggtcgaccaacgaaattactattaactggaatggtgcattggtttgggcaatggcgttttatgatgactacgccgattcgggtagcggttctagctcgtcaagttcttctagctcatctagctcttcgtcaagttcttccagttcgacttctagctcgtcgtcttctagtagtagctcttcgtcgagcggctcgagttcttctagcagctcttccacatccagttccagctcttcgagttcatcgggtggggagtgtgtagaaatgtgtaagtggtatcaagatgcaccgcgccctctatgcaataaccaaaacagcggttggggatgggagaaccagcagagttgtattggtagaacaacttgcgaaagtcaaagtggcaatggtggagtgattaattcgtgcggcacgtctagctcgagctcttcatctagctctagcagtagctcttcgagttcatccagctcttctagcagttcttccacatcaagctcgtcgagtagttcgtcttctagctcttctagttcgacttcaagttcttcgtcgagcagttcagggggcgttgcaggtgtggcttgtgcggtaaccaaaatgaaccattggggcagcggatatcaattagatgtaacagtttctaataatggtgctgcagcggtaagtggttggagtattgaactcgattttggtgaatcgccacagcttactggtagttggaatgctgctgtatcggcatctggtaatactgtatcggctactaacattagttggaacggtaatttaagcgctgggcaatctacctcttttggtatgcagggtaattcagatggttcgctgagcacgccaagctgtttagttaagtaa

SEQ ID NO: 33 - protein, 1072 aa, Microbulbifer degradans
MKNTLSFKTSLLAGLVASSLLVAACQGVKQQTEATQTKHNITLWPQASSPVIKSPDYEAEVEAKVEALLGQMTLEQKVGQILQPEIQSIKPHEVKEYHIGSVLNGGGSMPNRIENAPPIEWVKLADAFYDASMDDSDGGIAIPIIWGTDAVHGHGNVTGATIFPHNIGLGAARNPALIEKIGEITAKEVRATGIEWIFGPTLAVAQNDLWGRTYESYSEDPAIVADYASAMVVGMQGKVDDSDFLSTNRVVATAKHFLADGGTLGGNDQGDARISEEELVQIHNAGYVPAIESGVQTVMASFSLWNGVKMHGNNYLLTQALKERMGFDGFIVGDWNGHGQVPGCTNESCPQSLNAGLDMYMVPYDWKKLYRNLISQVQSGEIAPSRLDDAVRRILRVKIRANLWAAKPSERINLATIDEVVGHANHREVARQAVRESLVLLKNKNSVLPIAANKTVLVAGDGADNIGKQSGGWSVSWQGTGNTNASFPGGTSIYKGIADAVTQGGGKATLSVDGSYKTKPDVAIVVIGEDPYAEGQGDRNSLEFEPVNKKSLELLKKLKADGIPVVTVFISGRPMWANPEINASDAFVAAWLPGSEGQGVADVLIGNANGKPRFDFKGTLSFSWPKLPTQGLLNPTHPNYDPLFKLGYGLTYASSETGPEQLAEDVEGVDKGSTGDINFYVGRTLEPWEVFVRTPESSQRLSGPFADLGNASVRTSDMQVQEDALTFTWGGSWMSILGIEGGRGYDLSSQYKEGGVISFNFNSIDMAKGDLKVQMACGEGCTREVDITTIARDLEGKGWQSLTVPLACFAHEGDDFTHITAPFNLFAGGKGQVAVANIRILRAGTQTVPCVLPKDVSVTPEPLNASWAIDWWMPRHKEKLARIQQGNVDLLMIGDSITHGWEDAGKDVWAQYYAHRNAVDLGFSGDRTENVLWRLQHGEADGIKPKVAVVMIGTNNAGHRHEPSHYTAKGVAAVVAELQKRLPETKILLLGIFPRGETSEDPLRVLNAKTNTLLAKMADGEKVVYLNINKTFLDENGVLPKDIMPDLLHPNEKGYALWAKAMEPTLKKMLGE

SEQ ID NO: 34 - DNA, 3219 bp, Microbulbifer degradans
atgaaaaatactttatcctttaaaacatccttgcttgcgggcttggtggcatccagtttactggttgcggcctgtcagggtgttaaacagcaaacggaagctactcagacaaagcacaatattaccttatggccgcaggcgtctagccctgtaataaagtcgccagattacgaagcggaagtggaagccaaggtagaagcgttgttaggacaaatgacgctagagcaaaaagtagggcaaatcctacagccagaaattcaatctattaagccgcatgaagtaaaagaataccacattggctctgtactaaatggtggtggctctatgcctaaccgcatagaaaatgcgccgcccattgaatgggtaaaattggccgatgccttttacgatgcctctatggacgattctgacggtggaatcgcaattcccattatttggggtaccgatgccgtacacggtcacggcaatgtaactggcgcaaccatattcccgcataacataggccttggtgctgcacgcaacccagcgcttatcgaaaaaattggcgaaataacggcaaaagaagtacgcgcaaccggcattgaatggatatttggcccaactttggccgtagcgcaaaacgatttatggggccgcacttacgaaagctactcggaagacccagccatagtggccgactacgccagtgccatggtggtaggtatgcagggcaaagtggacgacagcgattttctgtccactaatcgcgtagttgccacagcaaagcactttttagctgacggcggtaccttaggaggcaacgatcaaggtgatgcgcgcataagcgaagaagagttggtgcaaattcataatgcgggctatgtgcctgccattgaatcgggcgtgcaaacggttatggccagtttctctttgtggaatggcgtaaaaatgcatggtaacaactacctacttacccaagcacttaaagagcgtatggggtttgatggttttatagtaggggattggaatggccacgggcaggtacctgggtgcaccaacgaatcttgccctcaatcgctaaacgccggtttagatatgtacatggtgccttacgattggaaaaaactgtacagaaacttaattagccaagtgcaatcgggtgaaattgccccaagccgtttagatgacgctgtacgccgtattcttcgggtaaaaattcgcgctaatttgtgggctgcgaaaccttcagagcgaattaatctagccactattgacgaggtggttggccacgcaaaccaccgtgaggtagcgcggcaggcggtgcgagaaagtttagtattgttaaaaaataaaaatagcgtactgcctattgctgccaataaaaccgtgctggttgcaggtgacggcgccgataatattggcaaacaatctggcggttggagtgtaagctggcagggcactggtaacaccaatgcatccttccccggtggtacatctatttataaaggtattgccgatgcagtcactcagggcggcggtaaagctacgctttctgtggatggcagctacaaaactaaacccgatgttgccattgtggtaataggcgaagacccttacgccgaaggccaaggcgaccgcaatagtttagagttcgagccggtgaataaaaaatcgcttgagctattaaaaaaattaaaagcagatggcatacccgttgtaacagtatttatttctggccgacctatgtgggctaacccagaaattaacgcgtctgatgcatttgttgccgcgtggttacctggctctgaagggcagggcgtagcagatgtacttataggcaacgccaacggcaagcctcgttttgatttcaagggcaccttgtcgttctcttggcctaagctgccgacccaaggcttgctcaacccaacgcaccccaactacgacccgttatttaaattgggatacgggctaacttatgcctcgagtgaaactggcccagagcaattggcggaagatgttgaaggtgtagataaaggctcaaccggcgacattaatttttatgttggccgcacattagagccgtgggaagtgtttgttcgaactcctgaaagttcgcagcgtttaagtggcccatttgcagacttaggcaatgccagtgtgcgtaccagtgatatgcaggtacaagaagatgcccttacttttacttggggcggtagctggatgtctattctgggaatagaaggagggcgcggttacgacctttcttcgcaatataaagaaggcggagtaataagctttaacttcaattcaatagatatggctaaaggcgatttaaaagtacaaatggcctgtggtgaaggttgcacgcgtgaagtagatatcacaactatcgcacgcgacttggaaggcaaaggctggcagtcgttaacagtgcccttagcgtgctttgcacacgaaggcgacgatttcacccatattactgcgccgtttaacttatttgccggtggaaaaggtcaagttgctgtagccaacattcgcatactgcgcgccggtacacaaaccgtgccgtgtgtattgcctaaagatgtttccgtaacgccagagccgctgaatgctagctgggcgatagattggtggatgccgcgccacaaagaaaaactggcgcgtatccagcaaggtaatgtggatttactaatgattggcgattccattacccacggctgggaagatgcaggtaaagacgtgtgggcgcaatattacgcgcaccgcaatgcagtggacttaggctttagtggcgaccgaaccgaaaacgtattgtggcgcttacagcacggcgaagcagacggtattaagcctaaagtggcagtggttatgattggtaccaacaatgccggccatcgtcacgagccttcgcactacacagccaagggtgttgcggctgtcgttgctgaattgcaaaaacgattgcctgaaacaaagatattattactgggtatattccctcgcggcgaaaccagtgaagaccctttgcgggtattaaatgccaaaaccaatactcttttggcgaaaatggccgacggagagaaggtggtgtatttgaatatcaataaaacgtttttagatgaaaacggcgtattgcctaaagatataatgcccgacctattgcaccccaatgaaaaggggtacgcattgtgggcgaaagcgatggaacccacccttaaaaaaatgctgggcgaatag

SEQ ID NO: 35 - protein, 862 aa, Microbulbifer degradans
MLKKINKKGLALSLAIAAMLSGCNEGDSNKTKPSAETLSATQASNTVANPSIWPKVTSKVAKDAKMEADISAILSGMTLEQKVAQMIQPEIRAFSKEDMKKYGFGSYLNGGGAFPNDNKHSTMADWVALADDMYEASIDDSIDGSTIPTMWGTDAVHGHNNVVKATIFPHNIGLGAMHNPKLMQQIGAATAKVVQVTGIDWVFAPTVAVVRDDRWGRTYEGYSEDPAIVKEYARAMVIGMQGEANSEAFMGDGTVIATAKHFLGDGGTDKGDDQGNNLSTEQELIDIHAQGYISAIEEGVQTIMASFNSWNGEKMHGNKSLLTDVLKKQMGFDGLVVGDWDGHGQVKGCSNASCAQAINAGVDIIMVPNEWKPMFENTVAQVKSGEISEARINDAVTRILRVKMRAGIFDGVKPSDRAFAAEEKYLGSAENRAIARQAVRESLVLLKNQNKLLPLDRKMNVLMAGSGADNIGKQSGGWTLSWQGTGNVNSDFPGATSIYDGVNQVVSSAGGKVELSENGNYQAKPDVAIVVFGENPYAEGVGDIEGIEYQLNNKRDINLLQKLKADGIPVVSVFLTGRPLWVNKELNASDAFVAAWLPGSEGVGVSDVLFKKADGSINYDFKGKLTYSWPKYDDQVVINKGDKDYAPLYPYGYGLTYSDVDTQGDDLPEETKVKIGRADDEPMAIFDSLPQSDLGFFLGDKANWVVPIATSVVTTHNSDNLTMRTYNWKVQEDARQLIWKGDSKANAFFAWPDPHNMQGMLEHKAAYSFSIKVDKAPAGDLTLGIHCMEECGKKLVLNEALSKIPAGEWGELTIDLACIADAEALAEVRSPFMLSTDAPASIVFGDVKLVPGGADSAAIKCD

SEQ ID NO: 36 - DNA, 2540 bp, Microbulbifer degradans
atgctcaaaaagataaacaagaaaggtcttgctttaagcttagcaattgcagcaatgctaagcggctgcaacgaaggcgacagcaacaaaaccaaaccaagtgcggaaaccctctccgctactcaagccagtaacactgtagccaaccccagcatttggcccaaggtaactagcaaggttgccaaagacgccaaaatggaagcagatataagcgcaatactcagcggtatgacccttgagcaaaaagtagcccaaatgatccaacccgaaattcgtgccttcagcaaagaagacatgaaaaagtatggttttggctcctaccttaacggtggcggcgcattccctaacgacaacaaacattccaccatggccgactgggttgccctagccgacgacatgtatgaagcctctatagacgacagcatagacggcagcactattccaaccatgtggggtaccgatgcagtacacggccacaacaacgtggttaaagcgactattttcccacacaacattggccttggcgccatgcataaccccaagctcatgcagcaaataggcgctgccacggctaaagtggtacaagttactggtatcgactgggtatttgcgcccactgttgcggtagtgcgcgacgaccgctggggccgtacttacgagggctactctgaagaccccgccatagtaaaagaatacgctcgcgccatggttattggcatgcagggcgaagccaatagcgaagcgtttatgggtgacggcactgttatagccaccgccaaacactttttgggcgatggcggcaccgacaaaggcgacgaccaaggcaacaacttatccaccgaacaagaattaattgatattcacgcccaaggctatataagcgccattgaagaaggtgtgcaaactatcatggcatctttcaatagctggaatggcgaaaagatgcacggcaataaatctctgcttaccgatgtccttaaaaagcaaatgggctttgacggtttggtggttggcgattgggatggccacggccaagtaaaaggttgctctaatgcaagctgtgcccaagccatcaacgccggtgtcgatatcatcatggtacccaatgagtggaaacccatgttcgaaaacaccgttgcacaagttaaaagcggcgaaatctctgaagcgcgaattaacgatgcagttacccgtattttacgtgtaaaaatgcgcgctggtattttcgacggtgttaaaccatcggatcgcgccttcgcagcagaagaaaaatacctaggctctgccgaaaaccgcgctatcgctcgtcaagctgtacgcgaatcgttagtgttgcttaaaaaccaaaacaaactgctgccattagaccgcaaaatgaacgttttaatggcgggttctggcgcagacaacatcggcaagcaaagtggtggttggacattaagctggcagggtactggcaacgtgaacagcgacttccctggcgcaacatctatttacgacggcgttaaccaagtagtgagcagcgctggcggtaaagtagagctaagcgaaaacggcaactaccaagccaaaccagatgtagcgattgtagtatttggtgaaaacccttacgcagaaggcgtaggcgatattgaaggtattgaataccaactaaacaataagcgcgatatcaatttgttacaaaaactcaaagccgatggcattcctgttgtatcggtattcttaaccggtcgtccactttgggtaaacaaagagcttaatgcctccgatgcttttgttgcagcttggctgccaggctctgaaggtgtaggcgtttctgatgtgctattcaaaaaagccgacggtagtattaactacgactttaaaggcaagctaacttactcttggccaaagtatgatgaccaagtagtaataaacaaaggcgacaaagattacgccccgctttacccttatggttacggcttaacctacagcgatgttgacacccaaggtgacgacttacctgaagaaaccaaagttaaaattggccgcgctgacgacgagccaatggccatcttcgacagcctaccccaaagcgacctcggcttcttccttggcgacaaagccaactgggtagtacctattgcaacaagtgtagttacaacgcacaacagcgataacctaaccatgcgcacctacaactggaaagtacaagaagatgctcgccagttaatttggaaaggcgacagcaaagccaatgccttctttgcatggccagacccacacaatatgcaaggcatgttagaacacaaagcggcttacagctttagcattaaagtagataaagcacccgctggcgacctaacactaggcatacactgcatggaagaatgcggtaaaaaacttgtgcttaacgaagcgcttagcaaaattcctgctggtgagtggggagagctaacaatagatctagcttgcatagcagatgccgaagccttggccgaagttcgctcacccttcatgctaagcaccgatgcacccgcatctatcgtgtttggcgatgt

SEQ ID NO: 37 - protein, 862 aa, Microbulbifer degradans; identical to SEQ ID NO: 35

SEQ ID NO: 38 - DNA, 2589 bp, Microbulbifer degradans
atgctcaaaaagataaacaagaaaggtcttgctttaagcttagcaattgcagcaatgctaagcggctgcaacgaaggcgacagcaacaaaaccaaaccaagtgcggaaaccctctccgctactcaagccagtaacactgtagccaaccccagcatttggcccaaggtaactagcaaggttgccaaagacgccaaaatggaagcagatataagcgcaatactcagcggtatgacccttgagcaaaaagtagcccaaatgatccaacccgaaattcgtgccttcagcaaagaagacatgaaaaagtatggttttggctcctaccttaacggtggcggcgcattccctaacgacaacaaacattccaccatggccgactgggttgccctagccgacgacatgtatgaagcctctatagacgacagcatagacggcagcactattccaaccatgtggggtaccgatgcagtacacggccacaacaacgtggttaaagcgactattttcccacacaacattggccttggcgccatgcataaccccaagctcatgcagcaaataggcgctgccacggctaaagtggtacaagttactggtatcgactgggtatttgcgcccactgttgcggtagtgcgcgacgaccgctggggccgtacttacgagggctactctgaagaccccgccatagtaaaagaatacgctcgcgccatggttattggcatgcagggcgaagccaatagcgaagcgtttatgggtgacggcactgttatagccaccgccaaacactttttgggcgatggcggcaccgacaaaggcgacgaccaaggcaacaacttatccaccgaacaagaattaattgatattcacgcccaaggctatataagcgccattgaagaaggtgtgcaaactatcatggcatctttcaatagctggaatggcgaaaagatgcacggcaataaatctctgcttaccgatgtccttaaaaagcaaatgggctttgacggtttggtggttggcgattgggatggccacggccaagtaaaaggttgctctaatgcaagctgtgcccaagccatcaacgccggtgtcgatatcatcatggtacccaatgagtggaaacccatgttcgaaaacaccgttgcacaagttaaaagcggcgaaatctctgaagcgcgaattaacgatgcagttacccgtattttacgtgtaaaaatgcgcgctggtattttcgacggtgttaaaccatcggatcgcgccttcgcagcagaagaaaaatacctaggctctgccgaaaaccgcgctatcgctcgtcaagctgtacgcgaatcgttagtgttgcttaaaaaccaaaacaaactgctgccattagaccgcaaaatgaacgttttaatggcgggttctggcgcagacaacatcggcaagcaaagtggtggttggacattaagctggcagggtactggcaacgtgaacagcgacttccctggcgcaacatctatttacgacggcgttaaccaagtagtgagcagcgctggcggtaaagtagagctaagcgaaaacggcaactaccaagccaaaccagatgtagcgattgtagtatttggtgaaaacccttacgcagaaggcgtaggcgatattgaaggtattgaataccaactaaacaataagcgcgatatcaatttgttacaaaaactcaaagccgatggcattcctgttgtatcggtattcttaaccggtcgtccactttgggtaaacaaagagcttaatgcctccgatgcttttgttgcagcttggctgccaggctctgaaggtgtaggcgtttctgatgtgctattcaaaaaagccgacggtagtattaactacgactttaaaggcaagctaacttactcttggccaaagtatgatgaccaagtagtaataaacaaaggcgacaaagattacgccccgctttacccttatggttacggcttaacctacagcgatgttgacacccaaggtgacgacttacctgaagaaaccaaagttaaaattggccgcgctgacgacgagccaatggccatcttcgacagcctaccccaaagcgacctcggcttcttccttggcgacaaagccaactgggtagtacctattgcaacaagtgtagttacaacgcacaacagcgataacctaaccatgcgcacctacaactggaaagtacaagaagatgctcgccagttaatttggaaaggcgacagcaaagccaatgccttctttgcatggccagacccacacaatatgcaaggcatgttagaacacaaagcggcttacagctttagcattaaagtagataaagcacccgctggcgacctaacactaggcatacactgcatggaagaatgcggtaaaaaacttgtgcttaacgaagcgcttagcaaaattcctgctggtgagtggggagagctaacaatagatctagcttgcatagcagatgccgaagccttggccgaagttcgctcacccttcatgctaagcaccgatgcacccgcatctatcgtgtttggcgatgtgaagttagtacctggcggtgcagatagcgcagctattaagtgtgactaa

SEQ ID NO: 39 - protein, 461 aa, Microbulbifer degradans
MKTFNPDFVWGAASSAYQVEGATTTDGRGPSIWDAFSSIPGKTYHNQNADIACDHYNRWQEDVAIMKEMGLKAYRFSISWSRIFPTGRGEVNEKGVAFYNNLIDELIKNDITPWVTLFHWDFPLALQMEMDGLLNPAIADEFANYAKLCFARFGDRVTHWITLNEPWCSAMLGHGMGSKAPGRVSKDEPYIAAHNLLRAHGKMVDIYRREFQPTQKGMIGIANNCDWREPKTDSELDKKAAERALEFFVSWFADPIYLGDYPASMRERLGERLPTFSDEDIALIKNSSDFFGLNHYTTMLAEQTHEGDVVEDTIRGNGGISEDQMVTLSKDPSWEQTDMEWSIVPWGCKKLLIWLSERYNYPDIYITENGCALPDEDDVNIAINDTRRVDFYRGYIDACHQAIEAGVKLKGYFAWTLMDNYEWEEGYTKRFGLNHVDFTTGKRTPKQSAIWYSTLIKDGGF

SEQ ID NO: 40 - DNA, 1386 bp, Microbulbifer degradans
atgaaaacctttaacccagatttcgtatggggagcagccagttccgcctatcaggtagaaggcgccaccaccaccgatggcagaggccccagtatttgggatgcgttcagttccattcccggtaaaacctaccacaaccaaaacgccgacatagcctgcgaccactacaaccgctggcaagaagacgtggccataatgaaagagatggggctaaaggcttaccgcttttctatttcttggtcgcgcatattccctactgggcgcggcgaagttaacgaaaaaggcgtagccttttacaacaaccttatcgacgaattaataaaaaacgacattaccccttgggtaaccctatttcactgggactttcctctggcactgcaaatggaaatggacggcctacttaaccccgccatcgccgacgaattcgccaactacgccaagctgtgtttcgcgcgctttggcgaccgcgttacccactggattaccctaaacgaaccttggtgcagtgccatgcttggccacggcatgggcagcaaagcccctggccgcgtatctaaggatgaaccctatatagccgcccacaacttgctgcgtgcacacggcaaaatggtagatatttaccggcgcgaatttcagcccacacaaaaaggcatgataggcatagccaacaattgcgactggcgcgaacccaaaaccgattctgaattagataaaaaagcagccgagcgcgccctagaattttttgtaagctggtttgccgaccccatttatttgggcgactacccagccagcatgcgcgagcgcttgggtgagcgtttacccacctttagcgacgaagacattgcgctaataaaaaactctagcgacttttttggtttgaatcactacaccaccatgcttgccgaacaaacccacgaaggtgacgttgttgaagatactattcgcggcaacggcggcatatcggaagaccaaatggtcaccctctccaaagacccaagctgggaacaaaccgacatggagtggagcattgtgccctggggctgtaaaaaattattaatctggttaagcgagcgctacaactaccccgacatttacattaccgaaaacggctgcgccctacccgacgaagacgacgtaaacatagccattaacgatacacgccgcgtagatttttaccgcggttatatcgatgcgtgtcaccaagcaatagaggccggcgtaaaactaaaaggctattttgcatggacacttatggataactacgaatgggaagaaggctacaccaaacgctttggcttaaaccatgtagatttcaccacaggcaaacgcacacctaaacagtctgcaatttggtatagcacgttaattaaagatggtgggttctag

SEQ ID NO: 41 - protein, 444 aa, Microbulbifer degradans
MNRLTLPPSSRLRSKEFTFGVATSSYQIEGGIDSRLPCNWDTFCEQPNTIIDNTNGAIACDHINRWQDDIELIANLGVDAYRFSIAWGRVINLDGSLNNEGVTFYKNILTKLREKNLKAYITLYHWDLPQHLEDAGGWLNRDTAYKFRDYVNLITQALDDDVFCYTTLNEPFCSAYLGYEIGVHAPGIKDLASGRKAAHHLLLAHGLAMQVLRKNCPNSLSGIVLNMSPCYAGSNAQADIDAAKRADDLLFQWYAQPLLTGCYPDAINSLPDNAKPPICEGDMALISQPLDYLGLNYYTRAVFFADGNGGFTEQVPEGVELTDMGWEVYPQGLTDLLIDLNQRYTLPPLLITENGAAMVDELVNGEVNDIARINYFQTHLQAVHNAIEQGVDVRGYFAWSLMDNFEWALGYSKRFGITYVDYQTQKRTLKASGHAFAEFVSSRS

SEQ ID NO: 42 - DNA, 1335 bp, Microbulbifer degradans
atgaatagacttacactaccgccttcttctcgtttgcgcagcaaagagtttacctttggtgttgcaacgtcgtcttaccaaattgaaggcggcatagattctcgcctgccctgtaattgggatacgttctgtgagcagcccaataccattattgataacaccaacggcgccattgcttgcgaccacataaatagatggcaagacgatatagaacttattgccaacctaggggtagatgcctaccgcttttctattgcgtggggccgtgttattaatttagacggcagcctcaataatgaaggcgttacattttacaaaaatattttaactaagcttcgcgaaaagaatttaaaagcttatataacgctataccactgggacttgccacaacatttagaagatgctggcggctggcttaaccgcgataccgcctacaagtttcgcgactatgtaaaccttataacccaagcgcttgatgacgatgtattttgctacacaacgttaaacgagcccttttgcagtgcctaccttggctatgaaattggtgtacacgcaccgggtataaaagacttagccagtgggcgcaaagccgcacaccatttattacttgcccatggcttagctatgcaagtgctgcgaaaaaactgccccaatagtttaagcggcatagtgttaaacatgagcccttgttacgccggcagcaacgcacaagcagatatagatgcagcaaaacgcgcggacgatttattatttcagtggtatgcacaaccgctacttactggctgctaccctgatgcaataaacagcctgccagacaatgccaaaccacctatttgtgaaggcgacatggcgttaataagccaacctttagattatttaggccttaactactatacccgcgcagtattttttgccgacggtaatggcggttttaccgaacaagtacctgagggtgtagagctaaccgatatgggctgggaagtttacccgcaaggcttaaccgatttactaatagacctaaaccaacgctataccctacccccgttacttattaccgaaaacggcgcagcaatggtggacgaacttgttaacggcgaagttaacgatattgcccgaataaattattttcaaacccatttacaagcggtacacaacgccattgaacaaggtgttgatgtacgcggttattttgcttggagcctaatggataattttgagtgggcactgggttacagcaaacgattcggtattacctatgtagattaccaaacacaaaagcgaacgctaaaagccagcggccacgcatttgctgagtttgtctcgagtaggagctaa

SEQ ID NO: 43 - protein, 866 aa, Microbulbifer degradans
MLLSLKNTQLKRSMNMNLKHLFLVALALNIAACNVKEPAATNDNHISYQAAREARLAKVEAEVERLLPLLTLEEKASLVHANSKFSIASIERLGIHEMWMSDGPHGVRYQIERHGWAPAGWTDDNSTYLPPLTTVAASWNPEIAALHGDVLGAEARHRRKDVILGPGVNLARLPLYGRNFEYMGEDPFLASRLAVAEIKAIQENDVAACIKHFALNNQELNRTGVNAKPDERTLREVYLPAFEAAVKEAGVHTIMGAYNEFRGTNANQSKHLVMDILKGEWGYKGVLLTDWNVDINTYDAAVNGLDIEMGTNVDSYDDYMLAQPMIDMIKAGSIPESVLDDKVRRILRVQLSIGMMDKYRLSGERNTAKHHEAARKIASEGIVLLKNENILPLNKNKIKNVLVLGPNADKVHGLGGGSSEVPALYEITPLQGLKQKLGDNVNITVMRARYDGVLMPIASDYVTSRHWTGTPAWNMVRYSDAARTQAIGDSAIVDSAYSSPAGTTKEYVTMTATIKPLKSGEHTLKTSVMGDFELKINGKTTVKHSSTSGDVVTQKIALNGGETYSFEILYSGNKNFTLGWDAPGDLFTAEKEYIAAAKKADVVFYFGGLTHGDDREAIDRPHMKLPNHQDPVISKVLAANPNTVVFLIAGSAVEMPWADKAKAIVWGWYGGMEAGNAYADMLFGDTNPSGKMPITLPKALEDTAPIALNDYNPVESLYTEGVFIGYRWFEKQNIEPLFPFGHGLSYTQFKYNNIKLSSANIKGDQTVTVSATITNTGKVAGAEVVQLYLHDEQASVERPAKELKGFQKVFLKPGESKAVNITLNKRALSFWDENSNDWLAETGKFNVLLGASVSDIRLQTSFQYQQ

SEQ ID NO: 44 - DNA, 2601 bp, Microbulbifer degradans
atgctgctaagcttaaaaaacactcaactcaaaagaagtatgaacatgaaccttaaacacctctttctggttgctttggcgctaaatattgctgcgtgcaatgtaaaagagcccgcggcgacaaatgataaccacattagctaccaagccgctcgcgaagcgcgcttggcaaaagttgaagccgaagttgaacgcctgctgccactattaacactagaagaaaaagcctctttggttcatgcgaacagcaaattctctatcgcctctatcgagcggctaggcattcacgaaatgtggatgtctgatggcccccacggcgtgcgctatcaaatcgaacgccacggctgggcaccagcaggctggacagatgacaactccacttacttaccaccgcttactaccgtagccgccagctggaaccccgaaatagctgcccttcacggcgatgtactcggcgcagaagctcgccaccgccgtaaagatgtaatattaggcccaggcgtaaacttagctcgcctgccactttatggtcgtaactttgaatatatgggtgaagaccccttcttggcatcacgtcttgctgtggcagaaattaaagccattcaagaaaatgacgtggccgcctgtatcaaacatttcgcgcttaacaatcaagagctgaatcgcaccggcgtaaacgccaaacccgatgaacgcacattacgcgaagtgtatttacccgccttcgaagccgccgttaaagaagcgggcgtgcacaccataatgggggcctacaatgaatttcgcggtaccaacgccaaccaaagcaaacatttagtaatggatattctaaaaggcgaatggggctacaaaggcgtgttactcacagactggaacgtagatatcaacacttacgatgccgctgttaacggcctcgatatcgaaatgggtacaaatgtagatagctacgacgactacatgcttgcccaaccaatgatcgacatgattaaagcgggcagcattccagagtcagtacttgatgataaagttcgtcgcatactgcgcgtgcaactcagcataggcatgatggacaaataccgcttatctggtgagcgcaatactgccaagcatcacgaagctgcacgcaaaattgcatctgaaggtattgtgctactaaaaaatgaaaacattctgccgctaaataaaaacaaaattaaaaacgtattggtgcttggccccaacgcagacaaagtgcacggtttaggcggtggctcgtcagaagtgccagcactttatgaaataaccccgttacaagggttaaaacagaagctgggagataatgtaaacattaccgttatgcgcgcacgctatgacggtgtgttaatgcctatcgccagtgattatgttacttctcgtcactggaccggcacacctgcatggaacatggtgcgttactcggatgctgcgcgcacccaagctattggcgactccgccattgttgattcggcttattcttcgcctgcaggcacgactaaagaatacgtcaccatgaccgccacaattaaaccgttaaaatcgggcgagcacacactcaaaacatcggtgatgggcgatttcgaattaaaaattaacggtaaaaccacagtaaaacatagcagcactagcggcgatgtagtaacccaaaaaatcgccctcaacggcggtgaaacatacagcttcgaaattttatacagcggcaataaaaactttaccttgggctgggatgcaccgggagatttatttaccgcagaaaaagaatacatagccgccgcgaaaaaagcggatgtagtgttttactttggcggcctaacccacggcgacgaccgcgaagcaattgaccgccctcacatgaagctgcctaaccatcaagacccagttattagcaaagtattagctgcaaacccgaacacggttgtatttttaattgcaggctctgctgtagaaatgccgtgggccgataaagctaaagctattgtgtggggctggtatggcggtatggaggccggtaacgcctacgccgatatgctatttggcgataccaaccccagcggcaaaatgccaataactttaccaaaggcactggaagatactgctccaatcgcactgaatgattacaaccctgttgaatcactctacaccgagggcgtgtttattggttaccgctggttcgaaaaacaaaacatcgagccgctattcccgttcggtcatggtttgtcttatacccagtttaagtacaacaatataaagctctctagcgcgaacattaaaggcgaccaaaccgtcaccgtaagcgcaaccattaccaatactggcaaagtggccggcgctgaagttgtacaactgtatttgcatgacgagcaagcaagcgtagaacgcccagcaaaagaacttaaaggtttccaaaaagtgtttttaaagccgggtgaaagcaaagcggtaaatattacgcttaataaacgcgccctttcattttgggatgaaaacagcaacgactggcttgcagaaacaggtaaatttaatgtgctattgggcgcatcagtaagcgatatacgcttacaaactagcttccaataccagcagtaa

SEQ ID NO: 45 - protein, 811 aa, Microbulbifer degradans
MKFGHFDDKAREYVITDPKTPYPWINYLGNEDFFSLVSNTGGGYSFYKDAKFRRLTRYRYNNVPVDNGGKYFYINDSGDVWSPGWKPVKAELDAYSCAHGLSYTRITGERNGIQAEVLSFIPLGTWAEIQKVSLKNTSGATKKFKLFSFAEWCLWNAEDDMTNFQRNFSTGEVEVEDSVIYHKTEFKERRNHYAFYSVNAPIQGFDTDRDKWKGLYNDFDKPDAVFEGEPRNSEAHGWSPIASHYLEVELAPGESKDLIFVLGYIEVAPENKWESKGVINKSPAKELIARFDSVEKVDAELTKLADYWANLLSTYSVESGDEKLDRMVNIWNQYQCMVTFNMSRSASFFESGIGRGMGFRDSNQDLIGFVHQVPERARERIIDIASTQFEDGSAYHQYQPLTKRGNNAIGGNFNDDPLWLILSTTDYIKETGDFSILEEQVPYDNDASKATSHFEHLKRSFYHTVNNLGPHGLPLIGRADWNDCLNLNCFSEDPNESFQTTGNKTGRTAESLMIAGLFVLYGNEFVKLCREIGQDGEAAEAQAHIDQMVEAVKKHGWDGEWFLRAYDYYGKKVGSKENEEGKIFIESQGFCGMAGIGLEDGLVEKSMDSVKEWLDCDYGIVLQQPAFTKYYIEYGEISTYPAGYKENAGIFCHNNPWIMITETLLGRGDKAFEYYRKIAPAYLEEISDLHKVEPYAYCQMIAGKDAYLPGEGKNSWLTGTASWNFAAITQYILGVKPDYSGLAINPCIPSSWDGFKVTRKYRGATYNIIVTNPTHVSKGVKSLTLNGNAIDGYIVPPQQAGTVCNVEVTLG

SEQ ID NO: 46 - DNA, 2436 bp, Microbulbifer degradans
atgaaatttgggcactttgacgacaaagcacgcgagtatgtaattaccgacccgaaaactccctacccgtggataaactacttaggcaacgaagacttcttcagcctagtatctaacactgggggtggctacagtttttacaaagatgcaaagttccgtcgtttaacacgctatagatacaacaacgtacccgtagacaacggcggtaaatatttttacatcaatgatagtggcgatgtatggagccccggttggaagccggtaaaagcagagctagacgcatacagctgcgctcacggccttagctacacccgcattaccggcgaaagaaacggcattcaagcggaagtacttagctttatccctctcggcacttgggccgaaattcaaaaagttagccttaagaatacctctggcgctaccaaaaaatttaaactgttttctttcgccgaatggtgcctatggaacgcagaagatgacatgaccaacttccaacgcaacttctccaccggtgaagtagaggtggaagactctgttatttatcacaagacagaatttaaagagcgccgcaatcattacgcattctactctgtaaacgcaccaattcagggcttcgacaccgacagagacaaatggaaaggcttgtacaacgattttgataaacccgatgccgtttttgaaggcgagcctcgcaactccgaagcgcacggctggtcgccaattgcatctcactatctagaagtggagctcgcaccaggcgaaagcaaagacttaatttttgtgcttggctatatagaagttgccccagaaaacaaatgggaatcaaagggcgttatcaacaagtctccagccaaagaacttattgcgcgtttcgatagcgtagaaaaagtagatgccgagttaaccaagctagccgattattgggcaaatttgctttctacttacagcgtagaaagtggcgacgaaaagctagaccgcatggtaaatatttggaaccaataccagtgtatggtgacatttaatatgagtcgctctgcgtctttcttcgaatctggcattggccgtggtatgggcttccgcgattccaatcaggatttgataggctttgtacaccaagtacccgagcgcgcccgcgaacgcataattgatattgcttctactcagtttgaagacggttcggcctaccaccagtatcagcctttaaccaaacgcggcaacaacgcaattggcggcaactttaacgatgaccctctttggctaatcctttctaccaccgattacataaaagagactggcgatttctctattttagaagagcaagtgccttacgataatgatgcgagcaaagccacaagtcattttgaacatttaaagcgctcgttttatcacacggttaataatttaggcccacatggcttgccacttattggtcgcgccgactggaacgactgcctaaacctaaactgctttagtgaagaccctaacgaatcattccaaaccacgggcaacaaaaccggcagaacggctgagtcgttaatgattgcaggtttatttgttttatacggcaacgagtttgtaaaactgtgccgtgaaataggccaagacggagaagcggcagaagcccaagcccatattgaccaaatggtagaagctgtgaaaaagcacggctgggatggcgagtggtttttgcgtgcttacgactactacggtaaaaaagtaggcagtaaagaaaacgaagaaggcaaaatatttatcgaatcgcaaggtttctgcggcatggcaggaatcggcctagaagacggccttgtcgaaaaatcgatggattctgttaaagaatggttagattgcgattacggtattgtgttgcagcaaccggcgtttaccaagtactacatagagtatggtgaaatctccacctaccctgctggctacaaagagaacgcaggtatcttctgccacaacaacccgtggattatgatcaccgaaactttgcttggccgcggtgacaaagcctttgaatactaccgcaaaattgcacctgcatacctagaggaaattagcgatcttcacaaagtagagccttacgcctactgccagatgattgcaggtaaagatgcctacttacctggcgagggtaaaaactcatggctaacagggaccgcttcgtggaacttcgctgcaattactcagtacattttaggcgtaaaaccagactatagcggtttagcaattaacccttgcataccgtctagctgggatggctttaaagttacccgtaagtatcgcggcgcaacctataacatcatcgtaaccaacccaacccatgtaagcaaaggcgtaaaatcgctcaccctaaatggcaacgctattgatggctacatagtgccaccgcaacaagctggcaccgtatgtaacgtagaagttacattgggctaa

SEQ ID NO: 47 - protein, 788 aa, Microbulbifer degradans
MLKAINNGERYQLTSPTAMPQSASFLWNKKMMIQVNCRGYAVAQFMQPEPAKYAYAPNLEAKTFMQPEQPYYAHHPGRFFYIKDEETGEIFSAPYEPVRSQLNNFSFNAGKSDISWHIAALGIEVELCLSLPVDDVVELWELKIKNGGAQPRKLSIYPYFPVGYMSWMNQSGDYSQTAGGIIASCVTPYQKVADYFKNKDFKDKTFFLHETAPAAWEVNQKNFEGEGGLHNPNAIQQETLGCGNALYETPTAVLQYRRELAAQEQQTFRFIFGPAFDESEAIALRNKYLSAEGFAKAKSEYQTYITSGKGCLQINTPDPELNNFVNHWLPRQVFYHGDVNRLTTDPQTRNYIQDNMGMSYIKPNITRQAFLHALSQQEESGAMPDGILLLEGAELKYINQIPHTDHCVWLPVCMQAYLDETNDYALLDEIVPYASGEKRETVEQHMHHAMRWLLQARDERGLSFIAQGDWCDPMNMVGYKGKGVSGWLSVATAYALNLWADVCEQRQQNSCANEFRQGAKDINAAVNKHIWDGEWFGRGITDDGVLFGTSKDKEGRIFLNPQSWAILGGAADEQKIPCLLDAVEQQLETPYGVMMLAPAFTAMRDDVGRVTQKFPGSAENGSVYNHAAVFYIFSLLSIGESERAYKLLRQMLPGPDEADLLQRGQLPVFIPNYYRGAYYQHPRTAGRSSQLFNTGTVSWVYRCLIEGVFGLKGSPQGLVVQPQLPVAWQTAEAVREFRGATFNVSYRKSSDIKEMEIQLNESVISGNTISDITAGATYQLTVLLPATH

SEQ ID NO: 48 - DNA, 2367 bp, Microbulbifer degradans
atgttaaaagccattaacaacggcgaacgctatcaactcactagccctaccgctatgccgcaaagcgcatcgtttttatggaataaaaaaatgatgatacaagtaaattgccgcggctacgccgttgcgcaatttatgcagccagaaccagccaaatacgcttacgcacccaatctggaagcaaaaacatttatgcaaccagagcaaccctattacgcgcatcaccccgggcgctttttctatataaaagatgaagagacaggcgagattttttcggcaccctacgagcctgtgcgcagccagctgaacaactttagctttaacgcaggcaagagcgatataagctggcatattgccgctttaggcattgaagtagagctatgtcttagcctgccggtggacgatgtagtagaattgtgggaactaaaaataaaaaacggcggcgcgcaacctcgtaaactcagtatttacccgtactttcctgtgggttacatgtcgtggatgaatcaatctggtgactacagccaaaccgccggcggcattattgccagctgcgtaacgccttatcaaaaagtcgccgactactttaagaataaagactttaaagataaaacgttctttcttcacgaaaccgccccagcagcatgggaagtaaaccagaaaaacttcgaaggcgaaggcgggttgcacaaccccaacgccatacaacaagaaacgctgggctgcggcaacgcattgtacgaaacgcccacagcggtattgcaataccgccgcgaacttgcagcgcaagagcagcaaacctttcgctttatttttggcccagcatttgacgagagcgaagccattgcactgcgcaataagtatttatctgccgaaggttttgccaaagcaaaaagcgaataccaaacctatataacgagcggcaaaggctgcttgcaaattaacaccccagacccagaactaaacaactttgtaaaccactggctaccgcgccaagtgttttatcacggcgatgtaaaccggttaaccaccgacccgcaaacgcgcaattatattcaagacaatatgggcatgagctacattaagcccaacattacgcggcaggcgtttttacatgccttaagccagcaggaagaaagcggtgcaatgcccgacggcattttattgcttgaaggcgccgagcttaaatacataaaccaaataccccataccgatcactgcgtttggctgccggtgtgtatgcaagcctatttggatgaaaccaatgactacgccctattagacgaaatagtaccctatgcgagtggcgagaagcgcgaaactgttgagcaacatatgcatcacgctatgcgctggcttttgcaagcacgcgacgaacgcggcctaagctttatcgcacagggcgactggtgcgaccccatgaacatggtgggctacaagggcaaaggggtatccggctggctttcagtcgctaccgcttatgcattaaacctgtgggcagatgtttgcgaacaacggcagcaaaacagttgcgccaacgaatttagacagggcgctaaagatataaacgcggcggtaaacaagcatatttgggatggcgaatggtttggccgcggcattacagatgacggcgtactgtttggcaccagcaaagataaagaaggcagaatttttctaaacccacaaagctgggcaatacttggcggcgccgccgacgaacaaaaaatcccatgcctgctagacgcagtagagcaacaactggaaaccccttacggcgtaatgatgctggcccccgcgtttaccgccatgcgcgatgacgtaggccgagttacccaaaaattcccaggctctgcagaaaacggctctgtttataatcacgcggcggtgttttatatatttagcttgttatccattggcgagagcgaacgcgcatataaactgctacgccaaatgctgcctgggccagatgaagccgatcttttacagcgcggccaactgccagtattcatacctaactattatcgcggcgcatactaccagcacccccgcaccgccggtcgctctagccagctctttaatacgggtacagtctcgtgggtttaccgctgcttaattgaaggggtattcggcttgaaaggctcgccacaaggcttagttgtacaaccgcaactgcctgtcgcctggcaaacagcagaagccgttagggaatttagaggcgcaacgtttaacgtgagctaccgcaaaagcagcgatataaaagaaatggaaatacagctaaatgaatcggtaataagtggcaacaccatctccgacatcaccgccggcgcgacctatcaattaaccgttctattacctgccacacactaa

SEQ ID NO: 49 - protein, 574 aa, Microbulbifer degradans
MKKLIKPTLSWVAGVALSLGIAQGAGAQNVQFVGNITTNGSVRNDFMDYWDQITPENEGKWGSVERSRDNYSWSGQDAAYNFARANGIPFKAHTLVWGSQYPSWINNLSNAEKAAEIEEWIRDYCNRYPATDIIDVVNEATPGHAPANYARDAFGDNWIIKSFQLARQYCPNATLVLNDYNVLIWNTNDFIAMAQPVINAGVVDALGLQAHGLESLSASQLKSTLDRIANLGLPIYISEYDVRSTNDQEQLRIMRDQFPVFYNHPSVRGITLWGYMVGATWREGTGLIRADGSHRPAMTWLMNYLENNRGGSTSSSSSSSSSSSSSSSSSSGSSSGGPSSLTVELESLSDSSNFSPFSVQSDSSAAGGQYVVWPNNGNQIVSSPSDSASGQIQVHFTLSQSADVQFQIRADLANGNDDSFYYKLDSGSWNTQNNASTSGWGTLTPATFSNVSTGSHTLHILRREDGAKLDKVTLNASVGQVSASTGSSSSSSSSSSSSSSSSSSSSSGAAVASCDGVNEYPSWTAKDWSGGDYNHANSGDYMSYQGVLYRANWYTATVPGSDSSWTRVGDCNFV

SEQ ID NO: 50 - DNA, 1725 bp, Microbulbifer degradans
atgaagaagttaattaagcctacgctatcgtgggttgcaggagttgctttgtcgctgggtattgcccagggagctggtgctcaaaatgtgcagtttgttggtaatatcactaccaatggtagtgtgcgcaacgacttcatggactactgggatcagattaccccagagaatgaaggcaagtggggctcggtggagcgcagtcgcgacaactattcatggagcggccaagatgccgcctacaattttgcccgtgccaacggcatcccatttaaagcacatactttagtatggggcagtcaatatcccagctggataaacaatttaagtaacgcggaaaaagccgctgagattgaagagtggattcgcgattactgtaaccgttacccagccaccgatattatcgatgttgtcaatgaagcaacgccgggccacgcgccagcaaattatgctcgcgatgcatttggcgacaactggataatcaagtccttccagctggcacgtcagtactgccccaatgccacgttagtgttgaacgactacaacgtacttatttggaacaccaatgattttatagcgatggcccagccggtaattaacgccggagtagtagatgctttgggtttgcaggcccacggtctggagagcctttctgcgtcgcaattaaaatcgactctggatcgtatcgccaatttgggtttgccaatttatatctctgaatacgatgttcgcagcaccaatgatcaggagcagctgcgtattatgcgtgatcaattccctgtattttacaaccacccaagtgtacgtggcataactttgtggggttatatggtgggggccacctggcgagaaggcacaggtttgattcgtgctgatggctcccatcgtccagcgatgacctggttgatgaactatctggagaacaatcgtggcggctcaacctcttcaagtagttcatcctcctctagcagttcgtcttccagtagttcttcttcgggaagttcctctggtggcccaagtagtttgacggtagagctagaatctttgtcggatagcagtaacttttcgccattctcggtacagagtgacagcagcgcagcgggcggccagtacgtggtatggcctaacaacggcaatcagattgtaagctcaccctccgatagcgccagcgggcaaattcaggtgcactttaccctgtcgcaatcggcggatgtgcaatttcagattcgtgcagacctagctaacggcaatgacgactctttttattacaagctggactcaggctcttggaatactcagaacaacgcttccacgtctggttggggcaccttaaccccagcaactttctctaatgtatccacaggatcccataccttacacattctccgcagagaagatggggcgaaactcgataaggtaactctgaatgcttcagttggtcaggtttccgctagtacaggcagtagctccagctcttccagcagctccagttcatccagcagttctagttcttcaagcagcagcggcgcggcagtcgcaagttgtgacggtgttaatgaataccccagctggacagcaaaagattggtctgggggtgactataaccacgccaatagcggtgactacatgagctatcagggtgttctatatcgagcaaactggtacaccgcaactgttcctggaagtgattcttcctggactcgagttggcgattgcaattttgtgtaa

SEQ ID NO: 51 - protein, 619 aa, Microbulbifer degradans
MIKLRQSIHGALARTVGIISISTGLVLAAQTASAACEYTVTNSWGSGFTASIRITNDTGSAVNGWAVNWQYANGNRVTNSWNATLSGNNPYSASNIGWNGGIQPGQSVEFGFQGTANGAAETPAVTGAVCATGSSSSSSSSSSSSSSSSSSSSSSSSSSSSSTSSSSSSSSSSSSGANCVEMCKWYQDAPRPLCNNQNSGWGWENNQSCIGRATCESQPSNAGGVVNSCPSSSSSSSSSSSSSSSSSSSSSSSSSSSTSSSSSSTSSTSSSSSSSSGSAANLYTLADFPIGVAVTAGNESRSFLSIAAKEATVKKHFDQITAGNIMKMSYLHPSENSYTFSQADAMVNWANSNGVSVHGHTFIWHSDYQVPNWMNNYSGNFASMMDTHVTTIADHFEGRVVSWDVVNEAIDESQSSCYRNSLFYQRLGKAYIANAFRAARAADPSVELYYNDYDTEGGNANKLNCLLQLVDDLQANNVPIDGVGFQMHVQIDWPSTSNIAAAFQAIVDRGLKVKITELDVPINNPYGSGSFPQYSTYTSQAAALQKARYKSIVKTYLTVVPAHLRGGLTVWGIWDGDSWLLDFDNRQGADDWPLLFSGPANGPYVEKEAFYGVAEALTE

SEQ ID NO: 52 - protein, 50 aa, Microbulbifer degradans
MLDELLDELELLLELELLDEELELELEELDPVAHTAPVTAGVSAAPLAVP

SEQ ID NO: 53 - protein, 103 aa, Microbulbifer degradans
MGKSAKVYKFAAEPLELELLEEVELVLDELELVDELELLDELELLDELELEELEELLELDGQLFTTPPALDGCDSHVARPIQLWLFSQPQPLFWLLHKGRGAS

SEQ ID NO: 54 - DNA, 1860 bp, Microbulbifer degradans
atgatcaagctacgtcaatctatccacggcgccttggcgcgtaccgtgggcataataagtataagcaccggacttgtactcgcagcgcaaactgcaagtgcagcctgtgaatacaccgtaaccaattcgtggggttcgggttttaccgcgagtattcgcataacaaacgataccggtagcgcagtaaacggttgggcggttaactggcaatacgctaatggcaaccgtgtaacaaattcatggaacgctacgctgtctggcaataacccttatagcgccagcaatattggttggaacggcggtattcaacctgggcagtcggtggaatttggttttcaaggcacggctaatggcgcggcagaaacaccagcggtaacgggggctgtatgtgctacagggtctagctcttccagctcaagctctagttcttcgtctagcagctctagttctagcagcagttcgagttcatcgagtagctcgtctagcacttcaagctcgtcatctagcagctcttccagttcatcgggcgcaaactgtgtagaaatgtgtaagtggtatcaagatgcgcctcgccctttatgcaataaccaaaatagtggttggggttgggaaaacaaccaaagttgtatcggccgagcaacgtgcgaatcgcaaccgtctaatgcgggtggggtggtaaatagttgtccgtctagttctagcagctcttcaagttcctctagttcgagctcgtctagcagttcaagctcgtctagcagttcaagctcgtctactagttctagttcatcaagcacaagttctacttcttcaagtagttctagctctagcggttctgctgcaaacttatataccttggcagatttccccattggcgttgctgtaactgcgggtaatgagagccgtagctttttatctattgctgcgaaagaggcaactgttaaaaaacacttcgaccaaattacagccggtaacattatgaagatgagttacttgcacccatccgaaaatagctacacctttagtcaagcggatgccatggttaactgggcaaatagcaacggcgtaagtgtgcacggccatacttttatttggcattccgattaccaagtaccaaattggatgaataattacagcggtaattttgcgtctatgatggatacccacgtaaccactattgccgatcattttgaaggccgagtagtaagctgggatgtggtaaacgaagctatcgatgagagccaatctagttgttatcgcaactctttgttttaccagcgtttaggtaaagcttatattgccaatgcgttccgcgcggcccgagcagcagaccctagcgtagagttgtattacaacgattacgataccgaaggtggcaatgccaataagttaaattgcttgttgcaattagtcgatgacttgcaagcgaacaatgtgcctatcgatggtgtgggctttcaaatgcacgtgcaaattgattggcccagcaccagcaatattgctgcggctttccaagctattgtggatcgcggcttaaaggtaaaaattactgagctggatgtgcctattaataacccttatggcagtggttcattcccgcaatattcaacttacacgtcacaagccgctgcgttgcaaaaggcgcgttataaatccattgtaaaaacctacttgactgttgtgccagcgcatttgcgcgggggcttaaccgtatggggtatatgggatggtgatagctggttgttagattttgataatcgtcaaggcgctgatgattggccgctattatttagtggcccagctaatggcccctatgtagaaaaagaagcattctatggcgtggcagaggcgcttacagaatag

SEQ ID NO: 55 - protein, 470 aa, Microbulbifer degradans
  MOD_RES (301)..(457): Variable amino acid
MNCTRRNIVKAGLLGSAFVALPAVARALPGLATKFRDQFYVGTAVSARSLNTPSGAFAATVAHQFNALTAENAMKPALLQPQMGEWRWQDADAIVRFAEQHQMLMHGHTLVWHSQTPDWFFQNKQGEPADKATLYRRQEEYINAVVGRYKGRVHSWDVVNEAEDEGKGWRKSHWYNICGPEFMERAFRLAHAADPKAHLCYNDYNMHLPQKREFLVKLFKDYIKRGVPIHGVGLQGHVGLDYPSLDELEKTIVAMADLGLKVHITELDVDVLPAPWQLASADISTKFEYDKSLNPYVDGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTMYKMRLPAKILA

SEQ ID NO: 56 - DNA, 1413 bp, Microbulbifer degradans
  modified_base (902)..(1369): a, c, g, or t
gtgaattgtacgcgtaggaatatagtaaaagcaggccttcttggctcggcattcgtcgccctgcctgccgtggcgcgcgcgctgcctggattggccacgaaatttcgcgatcagttttacgtgggcactgcggttagtgcgcgctcacttaatacgcccagcggcgcgtttgcagccactgtcgcgcatcaattcaatgcactaaccgctgaaaacgccatgaagcccgccttacttcaaccacaaatgggggagtggcgctggcaggatgccgatgccattgtgagatttgccgagcagcatcagatgctaatgcatggtcacacccttgtgtggcattcgcaaacgccagattggttcttccaaaacaagcagggcgaaccggcagacaaagcaaccctataccgcaggcaagaggagtatatcaatgccgtagttgggcgctataaagggcgggtacactcgtgggatgtggtgaatgaagcagaagatgagggtaaaggctggcgcaagagccactggtataacatttgtgggccagagtttatggaacgagcctttcgcttagctcacgcagcggacccaaaagcacacttatgttacaacgattacaatatgcacttgccgcaaaagcgcgaatttttggttaagttattcaaagactacattaagcgcggcgtgcctattcacggcgtagggttgcaggggcatgtgggcttagactacccctcgctggacgagttggaaaaaaccatcgtggccatggccgatttaggtctaaaagtacacattacagaattggatgtagatgtattacccgcgccatggcaactagctagcgcagatataagtactaaattcgagtacgacaaaagcttaaacccgtacgttgatggtttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactatgtacaaaatgcgcttgcccgcgaaaatattagcttaa

SEQ ID NO: 57 - protein, 1186 aa, Microbulbifer degradans
MLRSTQSTPIVKRKISAYVGWGLCVLLSVCTASISWAGNPIVSHVYTADPAARVINGRAYVMVTHDQDNQNDYGGLIDYYLFSSDDMVNWQDHGIVWNSRTDSSWASLAYAPDFIERNGKYYLYFPNGANSIGVAVADSPEGPYTDPLGRPLVDRNTPNANVDWLFDPGVFIDDDGQAFLYFGGGADGTARVIRLNNDMISTSGAAISIDVPNFFEALYMHKRNGIYYLSYSTNPSAGMSIDYMTSNNPTSGFTHRGTILPNPWENNSNNNHQSIIEFNNEWYIFYHNRAVANTRGDSTFSRSINVDRLYYNSDGSIREVNASSIGVPAVRNVNAFSINQAETFDQEGGIETEPSSEGTLNIQMGPGDWVKVANVDFGNGATQFNARVASAIDNSKLEIILGSLSNTPHASLEITNTGGWQNWQTQSTSFNAITGVHDVYLRGTSGHNLNWFEFEGENNGGSSQLTVELEDLASQSLFAPLSVRSDNMANNGAYIEWSNDGSNQILSVASEQSQGQISVPFTLSQASDVEFNVRVNLANGNDDSFYYKLNSNSWQTFNNQATTGWQVLTPNTFTGLSPGNHILTLLRREDGAKLDTLTLVASAGSIQTNNSSSSSTSSSSSTTSSSSTSSSSSSGAAPTGNVTYSINVTNDWQSGYCAELTVTNNTNNALQWQASVSMSDSVDSMWNASWSQSGNILNVSGVEWNNTLQAGQSQSGIGFCATRASSSSSSSTTSSTSGSTSSSSSSGGYTVPSNNFAVNGGVENNLQSWGATAGSVTRSTEQRYSGNASARITNRAENWHGLTFSVGELTQGNLYEVAVWVKLAAGSADTPITLTAKRQNDSDDSTYNEYTGIVTTIANDSEWVLLHGQYTQTGTAFEHFIIESESDSVSFYADEFSIGGEVTPKNEVGFFVGNITTNGNVRNDFTQYWDQLTPENEGKWGSVERTRDVYDWSGLDRAYNYAKQNNIPFKQHTMVWGSQQPNWIDSLSPAEQAAEIEEWIRDYCARYPDTEMIDVVNEATLGHAPANYAASAFGNNWIIRSFELTRQYCPNSILILNDYNVLSWNTQEFIQMATPAVNAGVVDAIGLQAHGLADWSLSDLETKLNQVAALGLPIYISEYDIEKTNDQEQLRVMQTQFPLFYNHPSVKGITIWGYVVGATWRDGTGLLHSNGTPRPALTWLMDYLNR

SEQ ID NO: 58 - DNA, 3561 bp, Microbulbifer degradans
atgttgcgaagcacccaatcaacacccattgttaagcgaaagatttctgcctatgtaggttggggtctgtgcgtgttacttagcgtctgcacggcctcgatctcttgggcaggtaaccctattgtgtctcatgtatataccgcagaccctgctgcacgggtaataaacggaagagcctatgtaatggttacccacgatcaggataaccaaaatgattacggtggtttgattgattactacctgttctcatcggacgatatggttaattggcaagatcacggtattgtgtggaattctcgaacagacagtagttgggccagtcttgcttacgccccagattttatcgagcgcaatggaaagtactacctgtactttcccaacggcgcaaactctattggtgtcgctgtggccgatagccctgagggcccctatactgatccactcggtaggccgctggttgaccgcaatacccccaatgccaatgttgactggctgttcgatcccggtgtatttattgatgacgacggacaagcctttttgtactttggtggaggcgctgatggaaccgcgcgcgttattcgtttaaataacgacatgataagtaccagtggtgcagccataagtattgacgtacctaacttctttgaagcgctatacatgcataagcgcaacggcatttactacttatcctactcgaccaaccccagcgcggggatgagcatagattacatgacgagtaataaccctacctcagggttcacccatcgcggcaccattttgcccaacccttgggaaaataattccaataacaaccaccagtcaattattgaatttaataacgaatggtacattttttaccacaatagagctgtcgcaaatacgcggggcgatagtaccttttcccgctctattaacgtggatcgtctttactacaattccgacggcagtattcgagaagtaaatgccagttcaataggtgtacccgcggtacgtaatgttaatgctttttccataaaccaagcagaaacattcgatcaagaaggtggcatagaaactgagccgtcttctgaaggtaccttgaatattcagatgggcccaggagattgggtaaaagttgctaacgtcgattttggtaacggcgccacacaatttaacgctcgagttgctagcgcaatcgataattcaaagctggaaattattttaggcagtctcagtaataccccgcatgcctcgctcgaaattaccaacacaggcgggtggcaaaattggcaaacacaaagcacaagttttaatgcaataactggtgttcacgatgtatacctgcgcggtacttctgggcacaacctaaattggtttgaatttgaaggcgaaaataatggaggaagcagtcagctaacggttgagttggaagacttggcttcgcaatctctttttgctccccttagcgtacgctccgataacatggctaataacggcgcttacattgaatggagtaatgatgggagcaatcagattctcagtgtggccagcgagcaatcgcaaggccaaatcagtgtcccatttactctatcgcaagcttccgatgtcgaatttaacgtacgcgtgaatcttgctaatggcaatgatgattcgttttattacaagctaaacagtaatagctggcagacttttaataatcaagctaccactggttggcaggtgctcacgcccaacaccttcactggtcttagccctgggaatcacattcttactctacttcggcgtgaagatggcgccaaattagataccctcacgttggtagcctccgcgggcagtattcaaaccaataacagctcatcaagttctacctccagcagtagttcaacgactagctcaagttcaaccagctcgagtagttcctctggcgccgcgccaactggtaacgttacttactctataaatgttactaacgactggcaaagtggttattgtgcggagcttaccgttaccaataacacgaacaacgctctgcagtggcaagctagtgtttctatgagcgatagtgtcgacagtatgtggaatgctagctggtcgcagagcgggaacatacttaacgtaagcggggtagagtggaataatacgttgcaagcagggcaaagccagagtggcataggattttgtgctacacgtgccagctcgtcttcctccagctctacaacaagttctacttccggttccacatcaagctctagttcatcgggaggctataccgttccgagtaataatttcgcagtcaatggtggtgtagaaaacaacctgcagagctggggcgcaacggcgggttcagtaacacgttctactgaacaacgttatagcggaaacgcaagcgcgcgtataacaaatcgagcagaaaactggcacggtttgacgttcagtgttggtgagcttacgcaaggcaacctgtacgaagttgcggtgtgggtaaaacttgcggcaggcagtgcggacacacctattacgcttaccgccaaacgacaaaatgatagcgacgattccacttataacgaatataccggcatagtcacgaccattgctaacgattctgaatgggtgctgctgcacgggcaatacactcaaactggcacagcgtttgagcattttattatcgagtcagaaagcgatagcgtaagtttttatgccgatgagttttctattggtggagaggtcacgcccaaaaacgaagtgggattttttgtgggtaacattaccactaatggcaatgtgcgcaatgattttactcagtactgggatcaactaacaccagaaaatgaaggaaagtggggttcggtagaacgcactcgtgatgtgtatgattggagtggactagacagagcctataactacgccaaacaaaataatattccgtttaaacagcatactatggtgtggggtagccaacagcccaactggattgattcgctcagcccagcagaacaggctgcagagatagaggagtggataagagattattgtgcgcgctatcctgatactgaaatgattgatgtggtaaacgaagcaacgctgggccatgctcctgctaactacgcggcgagtgcgtttggcaataattggatcattcgttcgttcgagcttactcgtcaatattgtcctaacagcattttaatattgaacgattacaatgttttaagttggaacactcaagagtttatccagatggctactccggctgtcaatgcaggcgttgtagatgcaattggattacaagcacacggcttagcggattggtctttaagtgatttagaaaccaaactaaaccaggttgcggcattgggtttacccatttatatatccgaatacgatatagaaaaaactaacgaccaagaacagctgcgcgtaatgcaaactcagttcccgctgttttataaccatccatcggtgaaaggcattactatttgggggtatgttgttggggctacttggcgcgatgggacgggattgttgcacagtaacggaacacccagaccggcacttacttggttaatggattacttgaatagatag

SEQ ID NO: 59 - protein, 670 aa, Microbulbifer degradans
MVIITMKAGLLLRILLTVLALNMLAACGGSSSNTKEPVTQPEPEPEQQPEPEPEPEPEPEPEPEPEPEPEPEPEPEMEPQPEPQAPPAGGVSIIDTNPNNASFWAGSNNGDVGSRAVIDVDHPEFSQATRITVSNPASDYWNGQLSFPLNASVAAGDVVLVRLYMRSVENTYESGASFTTVFIEDNIDFTKFLNREITAAQDWVEYYLPAEITDNHATGEVGLRIGFGAGPRAQVFDIGGVELLHYTNTDISAMPSTRPSYEGREPDAAWRTAAAERIEQHRKGDFELTVVDDGNPIANATIDVDFQKHAYHFGSVTVGHLLMGTSEDSAIYREKVLELFNQSGPENDLKWGPWEGEWGNNFNQTQTLNGLQWLRDNGLYTRGHVMVWPSKRNLPNLMQQYLPEGDPASANPEAKQVVLDHIDDIATATANYLDEWDVLNEPYDNHYLMDAFGDSVMVDWFNRARTNLPAHGLYINDYSILSAGGRNFAHQEHYTNTIQYLVDNNAPITGIGLQSHFGDSPTAITRIYEIIDQYSTAFPQLDIRATEFDVSTTDEDLQADFTRDFLTIFFSHPKTVGVQLWGFWANAHWYPNAALYDADWREKPNALAWKEQIFNEWWNDFDGTTNAQGKFDERGFYGDYQVTVTVGEEQQIFTFSLVKGGEQNFSFEWQ

SEQ ID NO: 60 - DNA, 2013 bp, Microbulbifer degradans
atggtcataataactatgaaagccggtttacttctacgcatcctattaactgtactcgcgctcaatatgcttgccgcatgtggcggtagttctagcaataccaaagaacccgttacccagccggaaccagagccagagcagcagccagaaccagaaccagagccagagccagagccagagccagaaccagagccagaaccagagccagaaccagagccagagcctgaaatggaaccgcagccagagccacaagcgccgcctgcaggtggtgtatctatcattgataccaaccccaacaatgcatcgttttgggcaggctcaaacaatggtgatgtgggcagtagggctgttatagatgtcgatcaccccgaatttagccaagcgacgcgcataaccgtaagcaaccccgctagcgactattggaatggtcagctctccttcccgcttaatgcgagtgtggcggcgggggatgtagtattagtgcgtttgtacatgcgctcggtggagaatacttacgaatcgggtgctagttttactaccgtatttattgaagacaacatcgactttactaaatttttaaaccgcgaaataaccgccgcgcaagattgggtagagtattacctacccgcagaaattaccgataaccatgcaaccggtgaagtgggcttgcgcattggctttggcgctggccctagggcgcaggtgtttgatattggcggtgtagagctattgcattacaccaatactgatataagcgctatgcctagtacacgcccaagttacgaaggccgcgagccagatgccgcatggcgtacagcggcggcagagcgaattgagcagcaccgcaaaggcgactttgagctaacagtagtggacgatggcaaccctatcgccaatgccaccatagatgtagattttcaaaaacacgcctatcattttggctcggtaactgttggccatctattgatgggcaccagtgaagatagcgccatttaccgcgaaaaagtgctcgagctatttaaccaaagtggcccagaaaacgatttaaagtggggcccatgggaaggcgagtggggcaacaattttaaccaaactcaaaccctaaacggcttgcagtggctgcgcgataacggcctgtacacacgtggccatgtaatggtttggccttctaagcgcaacttgccaaacttaatgcagcaatatttaccagaaggcgaccccgccagcgccaacccagaagcaaaacaagtggtgctggatcacatcgatgatatagcaaccgcaacagctaattatttagatgagtgggatgtactaaacgagccttacgacaaccactatttaatggatgcctttggcgatagtgtaatggtggattggtttaatcgcgcgcgtactaacctgcctgcgcacggtttgtacataaacgattacagtattttatctgcgggcgggcgcaattttgctcaccaagaacactacaccaacacgattcaatatttggtcgataacaacgcacccatcaccggtataggtttgcaaagtcactttggcgactcgcctacagccattacgcgtatttacgaaattattgatcaatacagtaccgcgtttccgcagttagatattcgcgcaacggaatttgacgtaagtacaacagatgaagacctgcaggcagattttacccgcgacttcttaacgatattctttagccaccctaaaacagtgggtgtgcagttgtggggtttttgggcaaatgcacattggtaccctaatgcagcgctttatgatgccgattggcgagaaaagcccaatgcactagcttggaaagagcaaatttttaacgagtggtggaacgactttgacggcacgaccaacgcacagggtaaatttgatgaacgcggtttttacggcgattaccaagtaactgtaaccgtaggtgaagagcagcaaatttttacctttagcctagttaaaggcggcgaacaaaactttagttttgagtggcaatag

SEQ ID NO: 61 - protein, 275 aa, Microbulbifer degradans
MNIKTFFPALIASVFLLINASTGYAASITKTLCNPADSDNGYGAGTFNGKFYSWFELSQEDITDCDTKIGFYNETNRHFRVEWNVAQSWGEDAIGGMGWSSGSRDRKIGYNVGQLTTNSSIQKALVAMYGWSCSTSGGNQISQEYYVVDTWDGGKFVPWDENANNGNGAPAQSVGTVSANGATYDVYKVRRNGAQYCFNGSSRSFDQFWSVRRTPRAINGNRNMDFRPHANRWDNSDLGFKVDGLSSGYQILAVEIFGDANLRHKGAADITLWPR

SEQ ID NO: 62 - DNA, 828 bp, Microbulbifer degradans
atgaacataaaaacattcttccccgcacttattgcaagtgtatttttattaattaacgccagcactggctatgcagcaagcattaccaaaacgctttgcaacccagccgattccgataacggctacggtgcaggaaccttcaatggcaaattttattcttggtttgagttaagccaagaagacattaccgattgcgatacaaaaattggtttttacaacgaaaccaatcgacactttagggtggagtggaatgttgctcaatcttggggagaagatgcaattggtggaatgggttggagctctggctcgagagatagaaaaataggttacaacgttggccaacttacaactaattcttctattcaaaaagcattggttgctatgtatggctggtcttgctctaccagtggtggcaaccaaatatcacaagaatattatgtagtggatacatgggacggcggcaagtttgtgccttgggatgaaaacgcaaataatggcaacggtgctccagcacagagtgtaggaacagttagcgctaatggtgcaacatacgatgtttataaggttcgccgcaacggtgcgcaatattgttttaatggcagcagccgctcgtttgatcagttttggagtgtgcgtagaacgcctagagcgattaacggcaaccgtaatatggattttcgcccgcacgccaaccgctgggacaacagtgacctaggttttaaagttgacgggttaagcagcggttaccaaattttagcggttgaaatatttggtgatgcgaacctaagacataaaggtgcagcagatattactttatggccacgctaa

SEQ ID NO: 63 - protein, 767 aa, Microbulbifer degradans
MKSINVCGRRLKQALAAIATAAATLWFTPVDAQTLTSNQTGTHGGYYYSFWTDSAGTVSMTLGNGGNYSSSWSNTGNWVGGKGWQTGGRKTVNYSGTFNPSGNGYLTLYGWTQNPLIEYYIIESWGTYRPGESGTYYGTVNTDGGTYDIYRTQRVNQPSIEGTATFYQYWSVRQQKRVGGTITTGNHFDAWASHGLNLGTHNYMVMATEGYQSSGNSNITVSEGSGSSSTSSSSSSTGGPSGTNIVVRAQGVSGQEHINLIIGGNVVADWTLSTSMQDYTYTGNAAGDLQVEYDNDASGRDVELDYVYVNGEIRQAEDMEYNTATYSGECGGGSYSQTMHCSGVIGFGDTSDCFSGNCNGASSTSSSSSSSSTSSSTSSGGNNNSGITVRARGTNGDEHINLIVGGNIVGNWTLTTSNQNYVYNGNASGDVEVQFDNDANGRDVILDYVIVNGETRQAEDMEYNTATYSGSCGGGSYSETMHCSGEIGFGHTDDCFSGNCTSSSGTTGSSGGTSSNNGTSSCNGYVGITFDDGPGNNTATLINLLQQNNLTPVTWFNTGQNIAANTGQFAQQKSVGEIQNHSYTHSHMLNWSYQQVRDELASTNQAIVNAGGATPTLFRPPYGETNSTINQAAQDLGLRVITWDVDSRDWDGASASAIANSANQLQNGQVILMHDASYNNTNGAISQFAANLRARGLCAGKIDPSTGRAVAPSTNTGGNTGSNTGNGGNGGMCNWYGTSIPLCQTTNDGWGWENSQSCVSQNTCNSQ

SEQ ID NO: 64 - DNA, 2304 bp, Microbulbifer degradans
atgaagtcaatcaatgtatgcggcagacgcctcaagcaagccctcgcagcaatagcaaccgctgcagcaactctctggtttacgccagtggatgcacaaaccttaacctcaaaccaaactggtactcatggtggttactactattccttctggaccgacagtgctggcactgtttctatgacactcggcaatggcggcaattacagttcatcgtggagcaataccggtaactgggtgggaggtaaaggctggcaaacggggggacgcaaaaccgtaaactattccggtacgtttaacccctcgggcaatggttatttaaccctctacggttggacccaaaacccactcattgaatactacatcattgaaagctggggcacctatcgcccaggtgaaagcggaacctactacggcaccgtcaacaccgatggcggcacttacgatatttatcgcacccaacgcgttaaccaaccgtcaattgaaggcactgcaacgttttatcagtactggagtgttaggcaacaaaaacgcgtaggcggcaccataacaaccggcaaccattttgatgcgtgggcgagtcatggccttaacctaggcacacacaattacatggtaatggccaccgaaggttatcaaagtagcggcaactccaatattaccgttagcgaaggcagcggttcgagcagtactagttcgagtagctctagcaccggtggcccaagtggtaccaatattgttgtgcgcgcacaaggtgtaagcggccaagaacatatcaatttaattattggcggtaacgtagtggcagactggacgctttcaaccagcatgcaagattacacctacaccggtaatgccgcaggcgacctgcaagtagaatacgacaacgatgctagtggtcgcgatgtagagctagactatgtgtatgtgaatggcgaaattcgtcaagcagaagacatggaatacaacaccgcaacttacagtggtgaatgtggtggcggttcctattcgcaaaccatgcactgcagcggtgtaattggctttggcgataccagtgattgttttagcggcaactgtaatggtgcatcttctacaagttctagttcgtctagtagctcaaccagctctagcacaagctctggcggtaacaataacagcggcattactgttcgcgcacgcggtaccaatggcgatgaacatatcaaccttattgttggcggcaatatagtaggcaattggacgctcaccaccagcaaccaaaattatgtttacaacggcaatgcatctggtgatgtagaagtacaattcgacaacgatgccaacggtcgcgatgttattctcgattacgtaatagtaaatggcgaaactcgccaagcggaagatatggaatacaacacggcgacctacagcggttcctgtggtggtggctcctattcggaaacaatgcactgcagcggcgaaattggttttggtcacaccgacgattgctttagtggaaattgcactagcagcagcggcacaaccggtagctctggaggaacatcaagcaataacggtacaagtagctgtaacggttatgtaggtattaccttcgatgatggcccaggcaataacaccgctacattaataaacttactacaacaaaataacttaaccccagtaacttggtttaacacaggccaaaatattgctgccaatacaggtcagtttgcccagcaaaaaagtgttggtgaaattcaaaaccacagctacacccattcccatatgcttaattggagctatcaacaagttcgcgacgaactcgccagcaccaatcaagctattgtgaatgctgggggcgcaacgccaactctattccgtccgccttatggcgaaacaaactccaccattaatcaagcggcacaagatttaggcctgcgcgtaataacctgggatgtagattcgcgcgattgggatggcgcaagcgcttcagctattgccaactcggctaatcagttgcaaaacggccaagtaattttgatgcacgatgccagctacaacaataccaacggagccatatcacaatttgcagccaatctaagagcaagagggctatgtgcaggtaaaatagacccaagcactggccgcgcagttgcaccaagcacaaataccggcggcaacactggcagcaatacaggaaatggcggtaatggcggcatgtgtaactggtacggcaccagcattccattatgccaaactaccaacgacggttggggctgggaaaactcacaaagctgcgtttcgcaaaatacctgtaactcacaataa

SEQ ID NO: 65 - protein, 360 aa, Microbulbifer degradans
MCLKINRCWVFVWLCICATTAHSETYVPADNDQYLYTGRIDFSDIKAPSLSWPGTSIKANFTGEHLEVVLDDQNGKNFFNVIIDGNDRFPYVLEAKQGEHRYLISSALSKGKHSVEIYKRTEGEEGATLFKGLWLADDSYLLKPPKRPKRRIEIYGDSITSGMGNEGADNGADHLGSEKNNYLAYGAITARNLNAELHTISQSGIGVMVSWFPFIMPQFYNQLSAVGNNDSIWDFKQWTPHVVVINLMQNDSWLIDREKRLTPIPADAQRIAHYQAFVQSIRAEYPKAQIICALGSMDATANEKWPNYVREAVKNMQDNGDNKIDTIFFEYIGYGQHPRVAQHNANADKLTKFIKKKMKW

SEQ ID NO: 66 - DNA, 1083 bp, Microbulbifer degradans
atgtgcctaaaaataaaccggtgctgggtgtttgtttggttgtgtatttgcgcaactactgcccatagtgaaacctacgtacccgcagataacgaccaatacctttataccggccgtatagattttagcgatataaaagcaccctcgctaagctggcccggcacaagtataaaagccaactttaccggcgaacatttagaggtagtgttagacgatcaaaacggtaagaatttttttaatgtgattatcgacggtaacgatcgatttccttatgtgctagaagctaaacaaggtgagcatcgatatttaatttcttctgcgctaagcaagggcaagcacagcgtagaaatttataaacgtacagaaggcgaagagggcgcaacgctatttaaagggctttggttagccgatgatagttatttattaaaaccccctaaacgcccaaaacgcagaatagaaatttatggtgactcaattacaagcggtatgggtaacgaaggcgcagataacggcgccgaccatttgggctccgaaaaaaataattaccttgcctatggggctattaccgcacgcaatttaaacgccgagctacataccatttcgcaaagcggtattggggtaatggtaagttggtttccgtttattatgccgcagttttacaaccagctaagtgctgttggtaataatgattccatatgggactttaaacaatggacgccccatgtagttgtaataaacctaatgcaaaacgatagctggctaatagatagagaaaagcgccttacgccaattcctgcagatgcacaacgcatagcccattatcaagcgtttgtgcaaagcattcgtgccgaataccccaaggcgcaaataatatgcgcactgggcagtatggatgcaaccgcaaacgaaaaatggccaaactacgtgcgcgaagctgtaaaaaatatgcaagataatggcgataataaaatcgatactattttctttgaatacatcggctacggccaacacccgcgcgtagcgcaacacaatgcgaatgcagataagttaactaaatttattaagaaaaaaatgaaatggtag

SEQ ID NO: 67 - protein, 973 aa, Microbulbifer degradans
MNYYLNKKRLGQLLTGAAIIPVLYACGSQEKNVEPATVNWHKTSDGVVVSLQDSEAKKVRLQVINDRIVRVTATPQQDFNNLPNTLMVVAKPEQTAFEVKQNDASVVLSTADLSAEVSLVTGVVSFKDEHGKVLTTEVDRGNFGAVTRDPGVVDADSFAIRQQFTSDENEGYYGLGQQQDGEVNYAGDNVELTTYNLEISIPYVVSSKDYALLWNNTSISRLGDPNPPEPLKEGFKLFDANGNPGGLTARYFDGDKLLLERVEADLDYQFLAQGSNRTTPMPDETADAKNLRIEWEGSIESDTNGVHELKMYSSGYAKLYLNGELVLDRWRMNWNPWYHNTKLEMQAGKKVALKLDWQVDGGYMRIKQHKPLPVAEQGRLSIASDTAKAIDYYFVVGDNKDELVSGYRTLTGKAVMLPKWVFGFWQSRERYKTQDEIIDALQEYRDRKIPIDNIVLDWSYWPQDAWGSHDFDEQFFPDPSALVDKVHELNGNIMISVWPKFYPTTDNYKALNAKGCMFNKNIEQKNLDWIGEGYLNGFYDAYNPECREMFWAQIRDKINVHGFDAWWLDAVEPDIHSNLSFEHRKDLMTPNALGTGAEVFNAYALPHAETVYQGERRDDGDKRAFILTRSGFAGIQRTGSAIWSGDVVSRWSDLKEQIAAGVGVGISGMPYWTFDIGGFTPEDRYRYSAKGSVGHFSMMNESEVPEWQEINLRWFQFGTFVPLFRSHGQNPYREIYNIADKGTEVYDSMVWYTKTRYRLMPYIYSLVGDAHHKDGTFMRALVMDFPSDLNVRDINDQYMFGPALLVNPVSEFKARSRDVYLPAGADWYDFYTGVKHTGGKTIKADAPLAKMPIFVKAGSIIPTGVEIQHVYDKPDAPYTLNVYTGANGSFEIYEDDGKTYAYEQGAWARIPVSYNDKTGELTIGDRVGSFEGMTKEREFRVRWISAKRDDAANFDTGVAKAVTYTGKAITIKR

SEQ ID NO: 68 - DNA, 2922 bp, Microbulbifer degradans
gtgaattattatttaaacaaaaagcgactggggcaattgctcaccggcgcggccattattcccgtgctatatgcatgtggctcacaggaaaaaaacgtagagcctgcaacggttaattggcataaaacaagcgacggcgtcgttgtaagcttgcaagatagcgaagcaaaaaaagtgcgcttgcaagtcattaacgatcggatagtacgtgttaccgctacgccacagcaggatttcaacaacctgccaaatacgcttatggtggtggccaagcccgagcaaacggcgtttgaagttaaacaaaacgatgcatctgttgtgttatcaacggcagatctatctgccgaagtgtcattagtaactggtgttgtaagttttaaagatgagcacggcaaggtgcttacaacagaagttgatcgcggcaattttggggcggtaacccgcgacccaggtgtggtggacgccgattcatttgctattcgccaacagtttacaagcgacgaaaatgaaggctactacggtttaggtcagcagcaggatggcgaagtaaactacgctggcgataacgtagagttaacaacttacaacttagaaatttctataccttatgttgtatcaagcaaagattacgcgctgctatggaacaatacctcaatttctcgtttgggcgaccccaatccacccgagccactaaaagagggctttaaactctttgacgctaatggtaaccccggcgggctaaccgcacgttattttgatggcgataaattactgctcgagcgtgtagaggccgatttagattatcaatttttagcgcaaggtagtaatcgcactacgcccatgcctgatgaaaccgctgatgcaaaaaatctgcgtattgaatgggaaggtagtatcgaatccgataccaacggtgtgcacgagttaaaaatgtattccagtggctacgctaaattgtatttgaatggcgagttagtgttagatcgctggcgtatgaactggaacccttggtatcacaacaccaagttagaaatgcaggccggtaaaaaagttgcattaaagttagattggcaagtagatggtggttatatgcgcataaaacagcataaaccactgccggtagcagagcagggacgtttgtctattgcttccgataccgcgaaagccattgattactactttgtagttggcgataacaaggatgagttggtgtctggctaccgtacgctcacaggtaaagcagtgatgctacctaagtgggtgtttggtttttggcaaagccgcgagcgctataaaacacaagatgaaattatcgacgccttgcaagaataccgcgatcgtaaaattcctatcgataacattgtattagattggagttattggcctcaggatgcatggggtagtcatgatttcgacgagcaatttttccccgacccatctgcactagtagataaagtacacgagctaaacggcaatattatgatttccgtatggcctaagttttaccctacaaccgacaactacaaagcgctaaacgctaaaggttgtatgtttaataaaaacatcgagcagaaaaacctcgattggattggcgagggttacctaaatggcttttacgatgcctataacccagagtgccgtgaaatgttttgggcgcaaattcgcgataagatcaatgtgcacggtttcgatgcttggtggttagatgcggtagagccagatatccattccaacctttcttttgagcaccgcaaagatttaatgacacccaatgcactcggcaccggtgccgaagtgtttaacgcttacgctttgccgcacgcagaaactgtttaccaaggcgagcgtagagatgacggtgacaagcgcgcatttattctaacgcgttctgggtttgccggtattcagcgcaccggttcggctatttggagtggcgatgtggtatcgcgctggtccgacttaaaagaacaaattgcagcaggtgtgggcgtgggcatttctggtatgccgtattggacgttcgatatcggtggctttactccagaagatcgctaccgttatagcgccaaaggttctgttggtcatttctctatgatgaacgaatcggaagtgcctgaatggcaagaaatcaatctgcgttggttccaatttggtacctttgtgccgctgtttaggtcccacggccaaaacccatatcgcgaaatatataacatcgccgataaaggcaccgaggtatacgacagcatggtgtggtacaccaaaactcgctatcgcttaatgccttatatttattcgttagttggcgatgctcaccacaaagacggcacctttatgcgcgctctggtgatggatttccctagcgaccttaatgtgcgcgatattaacgaccagtatatgtttggccccgcgctactcgtaaaccctgtgtcggaatttaaagcgcgttcacgggatgtgtatctacctgcgggcgcagattggtacgatttctatacaggtgtgaagcacacaggtggtaaaaccattaaggccgatgcaccgcttgccaaaatgcctatttttgttaaggccggctctattattccaacaggtgtagaaatccagcatgtgtacgataagcccgatgctccttacacccttaacgtgtataccggtgcgaatggcagcttcgaaatttatgaagatgacggcaaaacctacgcttacgagcaaggggcttgggcgcgcattcccgtttcgtacaacgataaaaccggtgagctaaccattggcgatcgcgtaggtagctttgagggaatgaccaaagagcgcgaattccgcgtgcgctggatatctgccaagcgagacgatgccgccaatttcgatacaggtgtggccaaagccgttacctatacgggtaaggcaataaccattaagcgctaa

SEQ ID NO: 69 - protein, 893 aa, Microbulbifer degradans
MNKHFLVGVITLGVILQGLTACSKSAAPNANQPQDTAASTATYPFRDASLSVDARVDDLVSRLTTTEKIAQMFNDTPAIERLGIPAYNWWNESLHGVARAGKATVYPQAIGLASTFDEDLMLRVATSISDEGRAKYHDFLSKDVRTIYGGLTFWSPNINIFRDPRWGRGQETYGEDPFLTGRMAINFVKGIQGENDNSDYLKAVATIKHYAVHSGPEKTRHSDDYHPTRKDLFETYLPAFRMAIAETNVQSLMCAYNRVDGAPACGNNELMQEILRGDMGFNGYVVSDCGAIADFYESRSHHVVDSPAEAAAWAVKSGTDLNCGDSHGNTYTNLHYALQQGLITEDYIDIAVKRLFKARIKLGMFDEQDRVPYSEIGMDVVGSPKHLALTQEAAEKSIVLLKNNGVLPLKAGVKVAVIGPNAVDEDVLVGNYHGVPVKPVLPLEGIVNRVGEANVFYAPGSAQIADIYSHYEPISAENFYHKDANGNLAAGLKAEYYADYYNAAEINDDTFSATPALNRIDADINFSWPVSPIDNSLDDEFSAVWTGILKPKKSGSYRFSGTVALAINGKPVNGAVNLKAGESYNIKAIFGVQKWWPVNAIHPYGKLTWLDESRDLEEEALAAARKADVIIFMGGIDAHLEGEEMPLELDGFTHGDRTHINLPKVQTNLLKQLKATGKPVVMVNFSGSAMALNWESEKLDAILQAFYPGEATGTALANILWGDVSPSGRLPVTFYKGVDDLPAFNDYHMENRTYKFYRGEPLYAFGHGLGYVDFAYNNLVVANTAEAGKALPIAVSVTNTGKMQAEDVAQVYISLLDAPANTPIRDLKAFKRTKLAAGESTELEFNLPARVLTYIDDNGKTQTYTGRVEVTVGSGQKGYVKENAIAVATINVQ

SEQ ID NO: 70 - DNA, 2682 bp, Microbulbifer degradans
atgaataaacactttttagtaggtgtaattacgttaggggtaattctgcaggggctaactgcatgtagcaaaagcgctgcacctaatgccaatcaaccgcaagataccgcagctagtacggctacctacccgtttagggatgcaagcttaagtgtagatgcccgcgtagacgacttggtatcgcgtttaaccacaaccgaaaaaattgcccaaatgtttaacgatacgcccgcaatcgagcgattgggtattcccgcctacaattggtggaacgaatcgttgcacggtgtggcccgtgcgggtaaagcaacggtatacccgcaggcaataggcttagcgtctacatttgatgaagacttaatgttgcgcgtggctacttctatttctgatgaggggcgcgctaagtatcacgacttcctatcgaaagacgtgcgcaccatatacggcgggcttaccttttggtcgccaaatattaatatcttccgcgacccgcgttggggcagggggcaagaaacctacggtgaagacccgttcttaacggggcgtatggccattaattttgttaagggtattcaaggcgaaaacgacaacagcgattacctaaaagccgtagcgacaattaagcactatgccgtacacagcggccccgaaaaaacgcgtcattcggatgactaccatccaacccgtaaagatttattcgaaacctatttgcctgcatttcgcatggcaatagcagagactaacgtgcaatcgttaatgtgtgcctacaaccgtgtagatggggcacctgcctgtggcaataatgaattaatgcaagaaattttgcgtggcgatatgggctttaacggttatgtcgtgtctgactgtggcgccattgccgatttttacgagagtagatcgcaccacgtggttgactcacctgcagaggctgcagcgtgggccgttaaatcgggtaccgatttaaactgtggcgattcacatggcaatacctacaccaacctgcattacgcgttacagcaaggtttaattacagaagattatattgatatagcggtaaagcgtttgtttaaagcgcgtattaagcttggcatgtttgacgagcaagaccgcgtgccttacagcgaaattggtatggatgttgtaggttcacctaagcacctagcgctaacccaagaagcggcagaaaaatctattgtgctgctaaaaaacaatggtgtattgccattaaaagcaggggtaaaggtagccgtaatagggccaaatgcagttgatgaagatgtattggtaggcaactaccacggcgtaccagtgaaacctgtgttgccgctagaggggattgttaatcgtgttggcgaggccaacgtattttatgccccaggcagtgcacaaatagccgatatatacagccactacgaaccgataagtgcagaaaatttttatcataaagatgcaaatggtaatttagctgcaggcttaaaagcagagtattacgccgattattacaacgcagctgaaattaacgacgatacctttagcgcaaccccagcgttaaatagaattgatgcagatattaatttctcttggcctgtatcgcctattgataattcgttagatgatgaatttagtgcagtatggacaggcatacttaaaccgaaaaagtcgggtagctaccgtttctcgggcacggttgcattagccattaacggcaaacctgttaatggggctgttaacctaaaggcaggtgaaagctataacataaaagctatttttggcgtgcaaaaatggtggcccgttaatgcaatacacccgtacggaaaacttacttggctagatgagtcgcgcgatttagaagaagaggcattagctgctgcccgaaaagccgatgtgattatttttatgggcggtatagatgcgcaccttgaaggcgaagaaatgccgctagagctagatggctttactcacggtgatcgtacgcacattaatttacctaaagtacaaaccaatttgcttaaacaattaaaagcaacgggtaaacctgttgtaatggttaactttagtggtagtgccatggctttaaattgggaaagcgaaaagctagacgcaatactgcaagcgttttacccaggtgaagcaaccggtacagcgttagctaatattttgtggggcgatgtaagcccgagtggccgcttacctgtaaccttttacaaaggcgtagacgatctaccagcatttaatgattaccacatggaaaaccgcacctataaattttaccgcggtgagcctttgtatgcatttggccacggtttaggttacgttgattttgcttataacaatttagtcgtagcaaatactgcagaagcgggcaaagcgctacctatagctgtaagcgtaaccaataccggtaaaatgcaagcagaagacgttgcccaagtttatataagtttgctagatgcccccgcaaacacgcccatccgcgatttaaaagcgtttaaacgtaccaagcttgcggcaggcgaaagcaccgagcttgaatttaacttgccggcgagagtgcttacctatatagacgataatggtaaaacccaaacctatactggcagggtagaagttactgttggctctgggcaaaagggatacgtaaaagaaaatgcgatagctgtagcgactattaacgttcagtag

SEQ ID NO: 71 - protein, 317 aa, Microbulbifer degradans
MYTYVSAIALFIFSIASSCCVAQNPLDFGSNIKTADPSGHIWADGRMYLYTSHDQECQEDFYMKDWHTFSSSDLINWTAHGPSLSVADITWADNYAWAPDAAYKNGKYYLFFPAGTGVKDRVNPEKSTKWMGIGVAVSDSPTGPFKDAIGAPLWTDPYANDPSIFIDDDGKGYLYFHGKGADYLVAEMADDLLSVKGEFHKMDMGGYEPKMEGPWVFKREGMYYFTMPENNRSLAYYMAKSPFGPWEYKGIFMQEEGGNNHHSIVQFKGKWILFYHRWLMGEGECKKKQRHTAAEYLHFNADGTIKEVKRTREGLTK

SEQ ID NO: 72 - DNA, 954 bp, Microbulbifer degradans
atgtacacatatgtatccgccatagcactatttatattttcaattgcctcgtcgtgttgtgttgcccaaaacccgctcgactttggcagtaatattaaaaccgcagatccgtctggccatatatgggctgatggcagaatgtacctttacacctcgcacgaccaagaatgccaagaagatttttatatgaaggattggcataccttttcgtccagcgacttaataaattggactgcccacggcccaagtttatctgtagcggatattacgtgggcagataactacgcatgggcgcccgacgcggcctataaaaatgggaagtactatttgttctttccggcgggaaccggtgttaaagatagagtaaaccccgaaaaaagcactaagtggatgggcattggtgttgcagtaagcgatagccctacaggcccctttaaagatgcgattggcgcccccttgtggaccgacccctatgccaacgacccaagtatttttatagatgatgacggcaagggctacttatattttcacggtaaaggtgcagactacctagtagccgaaatggcagacgatttactgagtgtaaaaggtgagtttcacaaaatggatatgggcggttacgagccaaaaatggagggcccttgggtttttaagcgcgagggaatgtattactttaccatgccagaaaacaatcgttcacttgcttactatatggcgaaatctccctttgggccgtgggaatacaagggcatttttatgcaagaagaaggcggtaacaaccaccattctattgtgcaatttaaaggcaagtggatattgttttatcaccgctggttaatgggcgaaggcgagtgtaaaaagaagcaacgccacaccgcagcggaataccttcactttaatgccgacggcacaattaaagaagtaaaaagaacgcgcgaggggttaactaagtag

SEQ ID NO: 73 - protein, 577 aa, Microbulbifer degradans
MKIKCLLLAVYAGLLAACALDAPLKTSSKPLAHFSWFEYQGNDEIFKAPLASNQYQNPILAGYHPDPSIVRVGEDYYLVNSTFGFYPGIPVFHSRDLVNWTQLGNAIHRPEQLSFDGIHLGYNGVYAPAIEYRDGTFYVINTCVACGGNFIVTATNPAGPWSDPIWLPEVIGIDPSLFFDEDGKTYIVHHRNPPVQKYPAHTALWVMEVDSKTFAPVSDDVMLVDGGDEAPWHTEYIEGPHIYKIDGTYYLYAPGGGTGYFHGQLVYRSDNVFGPYEANPNNPVLTQVGLPDDREHPVTATGHADLFQDTNGDWWTVFLGTRVYDLAKPPQDPGNFATGRETFMLPVTWQNGWPHVLEKGEAVPYRVTKPKLPAGKPAPRAMTGNFTVREEFTNASLAPHWLFVRTPRSKWWQTGNGELILEARADTIGAVNQPSFIGRRLAHMTASFATQLTFNPHTVGDEAGLLAVQNDEHFYAFGLGLNSKGQTVLRVRKKAGKNESIRGDTVAEQVVKLKHGHPIYLRVNIGKAELNFAYSTNGKRYTTLLNQADANLLTTAKAGGFTGAVVGMYAESTAQQN

SEQ ID NO: 74 - DNA, 1734 bp, Microbulbifer degradans
atgaaaattaagtgcttactccttgctgtttacgcgggtctacttgcggcttgcgcgctggacgcgccgctcaaaacctcaagtaaaccgctagcgcatttttcgtggtttgaatatcaaggtaacgacgagatatttaaggctccactcgcctcaaatcaataccaaaaccccatactcgccggctaccacccagacccaagtattgtgcgagtaggcgaagattattatttggtgaactccacctttggcttctaccctggcattccagtatttcacagccgtgacttagtgaattggacccaactgggtaacgctattcaccgcccagagcaactttcatttgatggtattcacttaggctacaacggcgtttatgcaccggcaatcgaataccgcgacgggaccttttacgtaataaatacctgcgtagcctgcggaggaaattttatcgttaccgccaccaatcccgcgggcccctggtcagacccaatatggctaccagaggtaattggcatagacccctcgctatttttcgacgaggacggcaaaacctatatcgtgcatcatcgtaatccacctgtgcagaaataccctgcccacacagccctgtgggtaatggaagttgactccaaaacatttgcgccggtatctgacgatgtaatgcttgtggacggtggcgacgaagcgccatggcacacagaatatattgaagggccgcatatatataaaattgatggcacctactacctctatgcccctggtggcggcacgggatacttccacggccaattggtgtatagatctgacaatgtatttggaccctacgaagccaaccccaataaccctgtgttgactcaagttggtttacccgacgacagagaacaccctgtaacggcaacgggtcatgcagatttatttcaagataccaacggcgactggtggacggtatttctgggtactcgcgtttacgatttagctaagccaccacaagaccccggcaattttgccaccggacgcgaaacatttatgttgccagtaacatggcaaaacggctggccacacgtgctcgaaaaaggcgaggctgtgccctaccgagtaaccaaacccaaattacctgcaggcaaacccgccccgcgcgcaatgactggaaactttactgtgcgcgaggaatttaccaacgcttcgcttgccccccactggctatttgttcgcacaccgcgttccaaatggtggcaaacaggtaatggcgaacttattttagaagcgcgcgccgataccattggggcagttaaccagccgtcgtttattggccgacggctcgctcatatgacggcctccttcgccacccaactaacctttaacccacacaccgttggcgacgaagcagggttactcgccgtacaaaacgacgaacacttttacgcctttggcctagggttaaacagtaaagggcaaaccgttttgcgcgtgcgtaaaaaagcgggtaaaaatgaatcgataaggggagatacggttgccgagcaggttgttaagcttaagcacggccaccctatttacctgcgtgtaaatataggtaaagccgaattaaatttcgcgtatagcaccaacggcaaacgctacaccaccttgttgaaccaagccgatgccaacctacttaccacagctaaagcgggcgggtttactggcgcagtagtgggtatgtacgccgaatccaccgcacaacaaaactaa

SEQ ID NO: 75 - protein, 566 aa, Microbulbifer degradans
MRLLPILLVSLLPLLSSCTSAINGQQNSQTSPVFDWFEYAGSDALYNTVAPSKNAYTNPVIKGFYPDPSIVRVGADYYLVNSSFGYFPGVPIFHSTDLVNWVQIGNILERPSQLQIPSGMGVSRGIFAPTLRHHNGIFYMITTMVDGGGNFIVTAKNPAGPWSDPVWLPEVGGIDPDLFFDDNGKAYILNNDAPIGEPLYDGHRAIWIREFDLATLKTVGDAKLIVNGGVDITTKPVWIEGPHLFKNKGAYYLINAEGGTSVNHSQVVFKAQSPWGPYIPWENNPILTQRHLPADRANPVTSVGHVDLVQTQHGDWWAVFLGCRPYKDNYYNTGRETFLLPVDWSGEYPVILRGDAEVPYHHQRPQLGASQQPAIALSGNFIERDEFDSALKLYWRKVRTPTNNFTDLTSQKGKLVLTANNTDLSDFGSPAFIARAQQHLTGSATTKLVYTPPHVGDKAGIAAFQNDEYFYALTVTKNNSGLAIQLEKQLGKNKEIVAQYPLQEKTLRNGLYLKIEFNNDKYDFSYSTNNTKWQSVGETQDGTILSTQSAGGFVGATLGIFAYTAH

SEQ ID NO: 76 - DNA, 1701 bp, Microbulbifer degradans
atgcgacttttacctatcttactcgttagcttacttccactgctctcaagctgcacaagcgccataaacgggcaacaaaatagccaaacctcgcctgtatttgattggtttgaatacgcgggaagcgatgctttatacaacacggttgcgccaagtaaaaatgcctataccaacccagtaataaaagggttttatccagatccaagcattgtaagagtgggagcagattactacctcgtgaactcttcatttggctacttccctggcgtgccgatatttcatagcacagatttagtgaattgggttcaaataggtaatattctcgagcgcccatcacaattacaaatacccagcggcatgggtgtgtcgcgaggtatattcgccccaacactgcgccaccacaacggtattttttacatgattactacaatggtagacggtggcggcaattttattgttactgcaaaaaaccccgcaggcccttggtcggacccagtatggttacctgaagtgggcggtatagacccagatttattttttgatgacaacggcaaagcctacatacttaacaacgacgcccccattggcgagccgctttacgatggccaccgagccatttggattcgcgaattcgacttagccacattaaaaaccgttggcgacgccaagttaatagtaaacggcggtgtagatataactaccaaacccgtttggatagaaggcccacaccttttcaaaaataaaggcgcttactatttaattaatgcagaaggtggcaccagcgtgaatcacagccaagttgtatttaaagcgcaaagcccttgggggccgtatattccttgggaaaacaatccaattttaacacagcgccatttaccggctgatcgcgccaaccccgtcacatccgttggccatgtcgatttagtacaaactcaacatggcgactggtgggcggtatttttaggctgcaggccctataaagataactactacaataccggccgcgaaacatttttattaccggtagattggtctggcgaataccccgtcattcttcgcggcgatgccgaggtgccctatcatcaccaacgcccccaattgggagcatcccaacaaccagccattgcccttagcggtaactttattgagcgcgatgaatttgactcagcacttaaactttattggcgcaaggttcgcacccccacaaacaactttacagatttaacctctcaaaaaggcaagcttgttttaactgcaaacaatacagatttaagcgactttggatcaccagcatttattgcgcgcgcacagcagcacctaacaggcagcgcaacaaccaaactggtttacacacccccacacgtgggcgacaaagcgggtattgctgcctttcaaaacgatgagtatttttatgcgcttaccgttacaaaaaataatagcggccttgccatacaactagaaaaacaacttggcaagaacaaagaaattgttgcgcaatatccactacaagaaaaaacgcttcgcaatggcttatatttgaaaatagaatttaataacgacaaatatgatttcagctattccacaaataacaccaagtggcaatcggtaggcgaaacacaagatggaactatattaagcacgcaaagtgcaggcgggtttgtaggtgccacgctaggtatatttgcatataccgcgcactaa

SEQ ID NO: 77 - protein, 319 aa, Microbulbifer degradans
MSMFNKKTLAAGIVAACLTNVSASYAANPAITDTHTADPAALVHGDTVYLYVGNDEAKDNRVFYDLKKWLVYSSKDMVNWTNHGSPLAATDFKWASGDAWAAHTVEKDGKFYWYTTVRHATINGFAIGVAVSDSPTGPFKDALGKALISNDMTTDTDIDWDDIDPAVFIDDDGQAYIFWGNTKPRWAKLKPNMIELDGPIHAIDIPHFTEALYVHKHGEYYYLSYATGFPEKTAYAMSKSIEGPWEYKGILNELAGNSNTNHQSVIDFKGKSYFIYHNGGLGQDGGSFRRSVCIDYLNYNADGTIKRIVMTSEGVDPVK

SEQ ID NO: 78 - DNA, 960 bp, Microbulbifer degradans
gtgagtatgtttaataaaaaaacactagcagccggtattgtagctgcatgtttaactaacgtaagtgcaagctatgctgccaaccccgcaattaccgatactcacacggccgatcccgctgcgttagtgcacggcgataccgtttatttgtacgtgggtaacgatgaagcgaaggataaccgcgtattttacgatcttaaaaaatggttggtgtattcatcaaaagatatggtgaactggaccaatcacggttcgccgttagctgcaacggattttaagtgggccagcggcgatgcgtgggcggcgcacacggtagaaaaagatggcaagttttattggtataccacggtgcgtcacgcaaccattaatggttttgccattggcgttgcagtaagtgatagccctacagggccattcaaagatgctttgggtaaagcactaataagtaatgacatgaccaccgataccgatattgattgggacgatatagacccagcagtatttattgacgacgatggccaagcgtatattttttggggcaacaccaaaccgcgctgggccaagttaaaacccaatatgattgaactagatggacctattcacgcaatcgatattccacactttaccgaagcgctatacgtgcacaaacacggtgaatattactacttaagctatgcgacaggctttccagaaaaaacagcttacgctatgagcaaatctatagaagggccgtgggaatacaaaggcattcttaatgaattggctggtaactcaaatactaatcaccaatctgtcatcgattttaagggcaagtcatactttatttatcacaatggtggcttgggtcaagatggcggtagcttccgtcgcagtgtatgtatcgattatttgaactacaacgcggatggtactatcaagcgaattgtaatgacatcagaaggtgtagacccagttaaataa

SEQ ID NO: 79 - protein, 385 aa, Microbulbifer degradans
MPEHTRKRLLSTLGLALSGTAITLTLVGCGKDNPATQTEGSHSAGHTEVAAEQTHDIGGPGPEGKPINDPLVTHIYTADPSAHVFDGKLYIYPSHDVEAGIPQNDNGDHFDMRDYHVLSMEEPGGKVTDHGVALAREDVAWAGRQLWAPDAAEKDGTYYLYFPMKDKDDIFRIGVASGSTPYGPFKAEPEPMPGSYSIDPSVFQDGDDYYMYIGGIWGGQLQRWTTGEYNPEDVYPADDEPALLPKMAKLSADMKSFAEPLRDIQILDENGELIKAGDNDRRFFEAAWVHKYNGKYYLSYSTGDTHYIVYAIGDNPYGPFTYQGVVLNPVIGWTNHHSIAEFKGKWYLFYHDSSLSGGVTHLRSVKMTELTHNPDGTIQTINAYK

SEQ ID NO: 80 - DNA, 1158 bp, Microbulbifer degradans
atgccagaacatacgcgtaagcgcttactatcaaccttaggcctagctttatcgggcacagctataaccctaacgcttgtggggtgcggtaaagacaaccccgcaactcaaacagaaggcagccacagcgctggccatacagaagttgccgcagaacaaacacacgacataggcggcccaggccctgagggcaagccaattaacgacccgcttgttacccacatatacaccgcagacccttctgcccatgtgtttgacggcaaactttatatttacccatcgcacgatgtggaagcgggtattccgcaaaacgataacggcgatcacttcgatatgcgcgattatcacgtgctttccatggaagagcctggtggcaaagtcaccgatcacggcgtagcccttgcgcgcgaagatgtagcttgggctggtcgccaactgtgggcgcccgatgcggctgaaaaagacggcacttactacctgtatttccccatgaaagataaggatgacatcttccgcattggtgtcgccagtggcagtaccccttatggcccatttaaagccgagccagagccaatgcccggcagctatagcatagacccaagcgtatttcaggatggcgacgactactacatgtacataggtggtatttggggcggccagttgcagcgttggacaaccggtgagtacaacccagaagatgtatacccagcggatgacgagcctgcgctattacctaaaatggccaagctaagtgcagatatgaaaagctttgccgagccattaagagacattcaaattttggatgaaaatggcgagctaattaaagctggcgataacgaccgacgtttcttcgaagccgcgtgggtacacaaatataacggcaagtattacttgagctattcaaccggtgacacccactatattgtgtatgccattggcgataacccatacggcccgtttacttaccagggtgtagtgctcaaccccgttattggttggactaaccatcactcaattgctgaatttaaaggtaagtggtatttgttctaccacgatagttcgctttccggtggtgtaacacatttgcgcagcgtgaaaatgacagagctaactcacaacccagatggcactatccaaaccattaatgcctataagtaa

SEQ ID NO: 81 - protein, 738 aa, Microbulbifer degradans
MATLGVNAAKFAMFAAICLQFSVAEAAKSRDGYGLWLDYQPITNTREREGYIKALSPWQVEGEAATADFIRQELTAALGAMLGVEAGPVGDYTHNSLAHPVARLLVATPEESAVIRSLALGDALTRVGQEGYLIKTTRYRDKPITIVTANTHAGLLYGTFKLLQLLQTGQAVSNLAIESAPATKLRVLNHWDNLDRYVERGYAGESIWNWHKLPHYKSQRYYDYARANASIGINGVVLNNVNADPLILTPQYLVKVKALADIFRPYGIKVYLSVKFSSPNLIGGLPTSDPLDKNVQAWWQAKANEIYSLIPDFGGFLVKANSEGQPGPGDFGRSHAQGANMLADALAPHGGNVMWRAFVYNVEANVERSKQAYNEFKPLDGTFRQNVLVQVKNGPIDFQPREPFSPLFGAMPKTPLMMEFQITQEYLGFSTHLVYLGPLYEEVLKADTYAKGAGSTVAKVVDGSLYGHGITGMAGVANIGSDRNWTGHIFGQANWYVFGQLAWNPEVSTKQIADDWIRMTLTRDDKAVNTIRAMMMASRETAVNYMTPLGLHHIMGWGHHYGPAPWIGEQKPDWMREDWTSVYYHSANATGLGKDRTASGSNVIAQYHAPLRQAYSDPKTTPTELLLWFHHLPWHYELANGNSLWHELVARYYLGAQAVAEMAKTWDGLEANIPPQLFKQVQMALAIQTQEAAWWRDACVLYFQSYSKQSLPEGFAKPKHSLEYYKGLSFPHAPGDGR

SEQ ID NO: 82 - DNA, 2217 bp, Microbulbifer degradans
atggctactttgggggtaaatgccgctaagtttgccatgtttgcagctatttgcttgcagtttagtgtcgccgaagcggctaaaagccgcgatggatatgggctgtggttagattaccagccaattaccaatacccgcgaacgcgagggctatataaaagcattaagcccatggcaggtagaaggcgaagctgcaactgccgattttattcggcaagagcttactgcagcgttgggcgctatgcttggcgttgaggctggtccagtgggtgattacacccataactccctcgctcaccctgtggcgcggctattggttgcaactccagaagaaagcgctgttattcgctctttggctttaggcgatgctttaactcgagtagggcaagaggggtaccttattaaaaccacgcgttaccgtgacaagcctatcaccattgttaccgcgaacacgcatgcaggcctgctgtatggcacattcaaactactgcagctgctgcaaacagggcaggccgtttctaatttagctattgagtccgccccagcaaccaaactgcgtgtgcttaaccactgggataacctcgatcgctatgtggagcgcggctatgccggtgagtctatttggaactggcacaagctgccgcactacaaatcgcagcgctactacgattacgctcgcgctaacgcgtccattggtattaacggtgtggtactaaacaatgttaacgccgaccccttaattcttaccccgcagtaccttgtaaaagtaaaagcactggcagatatttttaggccctacggcattaaagtttatctttcggtgaagtttagctcgccgaatcttattggcgggctgccaacatccgacccgttagataaaaatgtgcaagcttggtggcaagcgaaagcgaatgaaatttactcgctcattcccgactttggtggctttttagtaaaagcgaattcggaagggcagcccggcccaggggactttggccgcagccatgcacaaggggcaaatatgttggccgatgcactggcaccccatggcggcaatgtaatgtggcgcgcgtttgtatataacgtagaagccaatgtggagcgatccaagcaggcatacaacgaatttaagccattagacggtacctttaggcaaaacgtattggtgcaagtaaaaaatgggccaattgattttcagccacgtgaaccgtttagcccgctgtttggtgctatgcccaaaacgccgttaatgatggagtttcaaattactcaggagtacttggggtttagtactcaccttgtttacttggggccgctgtacgaagaagtacttaaggccgatacctatgcgaagggggcagggtctactgttgcgaaggtggtcgatggctcgctctacgggcacggtataacgggtatggctggggtagctaatattggcagcgatcgcaattggaccggccatattttcggccaagccaactggtatgtatttggccaattggcgtggaaccccgaggtaagcactaagcaaatagccgatgattggattcgcatgacactcacccgcgacgataaagcggtaaacaccattcgcgcaatgatgatggccagccgcgaaacggcggttaactacatgacgcccctggggctgcatcacattatggggtgggggcaccactacggcccagcgccgtggataggcgagcaaaaacccgattggatgcgtgaagattggacatctgtttactatcatagcgcaaacgccacagggctaggcaaagatagaacagcttctggcagcaatgtcatagcgcaataccacgcccctttacggcaggcctatagcgacccgaaaaccacgcccaccgagttgctattgtggtttcatcatttgccttggcattatgaattagcgaatggcaatagcctgtggcatgaactggtagcgcgttactatttaggcgcgcaggctgtggcagaaatggccaaaacgtgggatggcctagaagctaatatccccccgcagctattcaaacaagtacaaatggcgctggctattcaaacccaagaagccgcgtggtggcgcgatgcctgcgtgctgtattttcaaagctattctaagcagtcgctacccgagggctttgcaaaacctaagcactcgctcgaatactataaagggttaagcttcccgcatgcgccgggtgacgggcgttaa

SEQ ID NO: 83 - protein, 1316 aa, Microbulbifer degradans
MRNKLGSMLKMSAAIGGLVAAGSAVAGPVGFASLNGGTTGGAGGQVVYASTGAEINQAMCNRASDDTPLIIYVTGTINHGNTAKYSGSCDTTADEIQFKGVKNISLIGTGSGAVFDQIGIHLRDTSNIILQNLHIKNVKKSGSPTSNGGDAIGMESGVYNVWVDHCELEASGGESDGYDSLLDMKATTQYVTVSYTYYHDSGRGGLMGSSDSDDTNTFVTFHHNYYENMDSRLPLLRHGTAHAFNNYYNGIAKSGMNPRIGGQIKAENNYFENAHNPIGTFYTDDMGYWDLRGNIFGSNVTWASADDETPAGPNPTSTTSIHISYPYDLDDAACVPDIVKSTAGVGTGLAVSDGSCTITTPPSTSSSSSSSSSTSSTGSSSSSSSSSSSSSSSNGGSLVLGNNLSIGAGSDGSSKGAGSYGNVRDGDVSSYWAPSGSTGRVSIKWSGSQTVNAIVIKEAAGYEGNISGWQVTDNDTGAVLAAGSSVGTITFDAVTTSKINFEITSSNGTPTVAEFETYNATGSSSSSSSSSSSSSSSSSSSSSSSSSSSSSTGGTATLSTTVSGDQVTLNWSVNNATVTGQQIYRDVDSDPAGRVRIASGVTGNTYTDTGLANGTYYYWVKVTDSNSATINSNYSEAQVNVYTTSTTTFEEDAGYCSVDGSVDSNNSGFAGSGFANTDNASGNGVNYAVSVPVAGVYTLQVRFANGSSARPADVLVNYGNAGVFDLPSTGSWTSWSNSNEISVNLVAGNNIIRLEATTSGGLANIDSLSVTGVEPSAGDCNGSVGSSSSSSSSSSTSSTSSSSTSSGGSSTSSSSTSSSSTSSTSSSSTSSSSTSSTSSSSGGGTASCEQLINDPSVNWDESALASEQEIVACLAQSLGSPVGFGEGTTGGYDPSGGSNLVVIKKNIGISVEQQILDAISTENHNWIVFDKDDFAARTAVAMYRLDCDNADVRSALGGASAAQCRDHIAWCSANGISDEHDCENEFFNNRLNDSDLPIRNQMIQSNTTIDGRGANAYFFFNGFSIGKDSSGASLYAAQNVIVTNNEFIGAGHTEDHDLDPDMIRSTGESNKIWIHQNTFDHTGDSAFDVKVGAYDITISFNKLVNVKRAALHGSSDSRAINSQITTTMHNNLFYTSDDQYALSTYDTLRRVPLMRRGQSHMFNNVFYGYRKDILSVRVGGRIAFEDNIILNKESSSTPGDGLKKGDDMEYYVETLLRDFREGGLEISGSYVSFADSACNSYGASGDLTASHGATPDMFDDYSSASKNTISANRFVAGDDLTDYVFATAGKGGKAPYVSTFTAGQNSLISQANPVCQ

SEQ ID NO: 84 - protein, 93 aa, Microbulbifer degradans
MPPVELLDELLDEELDELLDEELEELELLEELEPVALYVSNSATVGVPLEEVISKLILLVVTASNVIVPTLEPAANTAPVSLSVTCQPLILPS

SEQ ID NO: 85 - DNA, 3951 bp, Microbulbifer degradans
atgagaaataaattaggctcaatgttaaaaatgagcgcagccattggcggtttagttgcagcgggttccgctgttgcaggcccagttggtttcgcaagtttaaacggcggcactaccggcggcgcgggcgggcaagttgtatatgctagcaccggtgctgaaattaaccaggctatgtgtaatcgcgcaagcgacgatacaccgctaattatttatgtgacgggtaccattaaccacggtaacaccgccaagtattctggtagctgcgataccactgcagatgaaattcagtttaaaggtgtaaaaaatatatcgttgataggaacgggcagcggtgctgtgttcgatcaaatcggtattcacctacgcgatacctcgaatattattttgcaaaatttgcatattaaaaacgttaagaagtctggttcgcctacttcgaatggcggtgacgctattggtatggaatctggcgtatacaatgtgtgggtagaccactgtgagctagaagcttcaggcggtgaaagtgatggatatgattcattgctagatatgaaagccaccacgcagtatgtaacggtttcttacacttactatcacgattctggtcgcggtggtttaatggggtctagtgatagcgacgataccaataccttcgtcaccttccaccacaactactacgaaaatatggattcgcgcttgccgttactgcgtcacggtacagctcatgcatttaacaactactataatggtattgctaaatctggcatgaacccacgtataggtgggcaaataaaagcggaaaacaattacttcgaaaatgcgcacaacccaattggtactttttatacagacgatatgggttactgggacttacgcggcaatatatttggcagtaacgtaacgtgggcgtctgcggatgatgaaacccctgcaggcccgaacccaacatccactacgtctattcatatttcttacccctatgatctagatgacgctgcttgtgtgcctgatattgtaaaatccacagcaggtgtgggtactggcctagcggtttcagacggaagctgcaccataacaacgccaccttcaacgagttcgtctagctccagttctagctcaacctcgtcgactggttcgagttcgtcttcaagctcttcctcttcaagcagctctagctccaatggcggcagcttagtattaggtaacaacctttcaattggtgctggctctgatggtagtagcaagggagcaggttcgtacggcaatgtgcgcgatggcgatgtaagtagctattgggcgccgagtggcagtactggtcgtgtttcaattaaatggagcggcagccaaactgttaacgctattgttattaaagaagcggcaggctatgaaggtaatattagtggttggcaagtaactgataacgataccggtgcagtattggctgctggctcaagcgtaggcacaattacgtttgatgcggtaacgactagcaagatcaatttcgaaattacttcttctaacggtacaccaacggtagcggaattcgaaacatataatgctacaggttctagctcttcaagcagctcgagttcttctagctcttcatcaagtagctcgtctagttcttcatcgagcagttcgtctagtagttctacaggcggcaccgctactttaagtacaacggtttctggcgatcaagtaacgttgaattggagcgtaaataatgcaaccgtaactggtcagcaaatttatcgcgatgtggattcagacccagctggccgtgtgcgcattgcatccggtgtaactggaaatacttacacagataccggtttggctaacggaacttattactactgggtaaaagtaaccgattcaaactcagctacaattaattccaactactcagaagcgcaagtgaatgtttatacaacatctactacaacgtttgaagaggatgcgggttattgctcggtagacggttcagtagatagcaataacagtggctttgctggcagtggttttgctaataccgataatgcttcgggtaatggcgtaaactacgcggtaagcgtacccgttgctggtgtgtacacgctgcaagtgcgttttgctaatggctcaagtgcacgtcctgctgatgtgttagtgaactatggtaacgccggtgtatttgatctgcctagcacaggttcttggaccagctggagcaactcaaacgaaattagcgttaacttagttgctggcaataatattattcgtttagaggctaccacgtctggcggcttggcgaatattgatagcctatctgtaacgggtgtagagccttctgcaggtgactgtaacggtagtgttggttctagcagttctagttcttccagctcttctacttctagcaccagttcatctagcactagctctggtggcagctctactagctcaagctcaacgtctagctcatctacaagctctacatctagtagttcaaccagctctagcagcacgtcttctacctcaagctcttcgggcggtggtacggcaagttgtgagcagttgattaacgatccaagtgttaactgggatgagtctgcactggcttcagagcaagaaattgtagcctgtttggctcagtctctaggtagccctgttggctttggggaaggtactaccggtggttacgatccaagtggcggcagcaaccttgttgttattaaaaagaacataggtatttctgttgagcaacaaattttggatgctataagcaccgaaaaccacaactggattgtgttcgacaaagatgattttgctgcgcgcactgcggtagcgatgtatcgcttagattgtgacaatgccgatgtgcgttcagcattgggtggcgcaagtgctgcacaatgtcgcgatcatatagcttggtgttctgctaatggtatttctgacgagcatgactgtgaaaatgaattctttaacaaccgtttaaatgattcagatttgccaatccgcaatcaaatgattcagtcaaacactaccattgatggtcgtggtgcaaacgcatacttcttctttaatggtttctccattggtaaagatagcagtggtgcaagcttgtacgcagcgcaaaatgtgattgtaacgaataacgagtttattggtgccggtcacactgaagatcacgatctagacccagatatgattcgatctactggcgaatcgaacaaaatttggattcaccaaaacacgttcgaccatactggtgattctgcgtttgacgtaaaggtgggtgcttacgatataacaatatcattcaataagttggtgaacgtgaagcgtgctgcgctacatggttcaagtgatagccgagcaattaactcgcaaatcacaaccactatgcacaacaacctgttctatacttcagatgatcaatacgcgctaagtacctacgacactttgcgtcgtgtaccgctaatgcgtcgcggtcaatcacacatgtttaacaacgttttctacggttaccgtaaagatattctaagcgtgcgtgttggcggtcgtatcgcctttgaagataacattattttgaataaagaaagcagctctaccccaggtgatggcctgaagaaaggcgacgacatggaatactatgttgaaaccttgttgcgcgacttccgtgagggtgggttagaaattagcggtagctatgtatcgtttgcagatagcgcttgtaattcctatggcgcatcgggtgacttaaccgcatcgcatggtgctacgccagatatgtttgatgattacagctctgcatctaaaaatactatatcagccaatcgctttgttgctggcgatgacttaactgactatgtatttgctactgcaggtaagggcggtaaagcgccttatgtttccacctttactgctgggcaaaatagccttatttcacaggctaacccagtttgtcagtag

SEQ ID NO: 86 - protein, 427 aa, Microbulbifer degradans
MNKNNVIAYLLISTFLLFSATVFAVKPSNAETRYSAMGADTPAGLGGTLPDGQSRIVRVTNLNASGEGSLAWALGLARPRVVVFEVGGVIDLAGQSITVTQPFLTVAGQSAPAPGITLIRGGLNIRTHDVRVQHIRVRPGDNLQPKRSGWESDGISVAGENAKDVHIDHVSVSWAVDENLSASGNRYKGYGQTAERVTFSNNLIAEALDYASHKKGKHSKGLLVHDYVRDVAVVRNLFVSNDRRNPYFKAHTIGFVANNIIYNAGNAAIQVNYIEREWEGQSTGPANARVAVVNNQLVYGRDTYSDLALVSVRGDAYLTGNSVTNLMGEPMPITEGAVNSLASAPSWLTGYELWDADEMRELLVASVGATPWARDAIDTRIINGVATGKARIIDSQQDVGGYPSYKQTNKKFDIPDDKIAEWLLGYL

SEQ ID NO: 87 - DNA, 1284 bp, Microbulbifer degradans
atgaataaaaataatgtaattgcttatctgctaatttcaacttttctattattttctgcgactgtgttcgcggttaaacccagcaacgctgaaacccgatattccgcaatgggtgcagataccccagcaggtttgggaggcactttgccagatggtcagtctcgtatcgttagggtgactaatttaaatgcaagtggggagggctcgctcgcatgggcgctgggtttagctcgaccacgcgtagtggtgttcgaagttggcggtgttatagatcttgctgggcaaagtattaccgtcacgcagccattccttactgttgccggtcagtcggcgccagcaccgggtattacattaattcgcggcggtttaaatatacgaacccacgatgtaagagtgcagcatattcgcgtgcggccgggagataacttacaaccaaagcgctccggctgggaaagtgacggtatatctgtggccggtgaaaatgccaaagatgtacatatagatcatgtatcggtaagttgggcggtagatgaaaacctctccgcttcggggaatcgttacaaaggttacggtcaaaccgctgagcgggtaacgtttagtaataatctcattgccgaagcgttagattatgccagccataaaaaaggcaaacactctaagggattattggtacacgattatgtgcgagatgttgccgtagttagaaatttgtttgtgtctaatgatcgtcgcaacccgtactttaaagcgcacaccataggttttgtagcaaataatattatttacaatgcgggtaatgccgctatacaggttaactatattgagcgtgagtgggagggccagagtacaggcccagctaatgctagagtagcggtggtaaataaccagttagtttacggccgcgatacatactcagacttggcgctagtgtctgtgcgtggggatgcttatttgacgggtaatagcgttacaaatttaatgggcgagcccatgcctattacggaaggggcggttaattctttagcctctgcaccttcatggttaacaggttatgagttgtgggatgctgacgagatgcgtgagctgctagtagccagtgttggtgcaacaccctgggccagggatgcgatagatacccgaataattaatggggtggcaacggggaaggcgcgaataatagatagccagcaagatgtgggtggctacccgagctataagcaaacaaataaaaaatttgatataccagacgacaaaattgccgaatggttactgggttacctgtaa

SEQ ID NO: 88 - protein, 769 aa, Microbulbifer degradans
MRNTKHLLNSGAVLLASSIATAAMAGPVGFASLNGGTTGGQGGQVVYANTGTQINEAMCNRPSHDTPLIIYVSGTINHGNTEKVSGNCDTTGDEIQFKKVKNLSLIGTGNGAVFDQIGIHLRETSNIILQNLHIKNVKKSGSPTSNGGDAIGMESGVYNVWVDHCELEASGGEKDGYDSLLDMKATTQYVTVSYTYYHDSGRGGLMGSSDSDDTNTYVTFHHNYYKNMDSRLPLLRHGTAHAFNNYYDGITKSGMNPRIGGQIKAENNYFENAHNPIGTFYTNDMGYWDLSGNIFGNNVTWASADDETPAGPNPQSTTSIHISYPYSLDDATCVPKIVKATAGVGNGLAVSTGGSNCGTSSSSSSSSSSSSTSSTSSTSSSSSSSNSSSGGSGVNLSIGAGSDGSSKGAGSYGDVRDGNMSTYWAPSGSTGRVSIKWSSATTVSSIVIKEAAGFEGNITGWQVVNNENGAVLKSGSNAGVISFSPVSTTKLNFEITSSNGMPTVAEFETYSGTVGGTSSSSSSSSSSSSSSSSSSSTSSSGGSANLGTSVSGDQVSLNWSTSNIDVGSQQVYRDTDSNPSGRVRISAGVSGNSYTDYGLASGTYYYWIKITDQNGVVYNTNAAEAVVGSQAPTTFTAQESAGFCSVNGSVDSNNAGYTGDGFVNTDNASGNAAVYAFNAPSAGMYSLQVRYANGSSARPGDVLVNAGNIGTFDFSSTGSWTSWANSNELSAYFSAGNNTVRIQATNSGGLPNLDSVSVTGNAPAAGNCN

SEQ ID NO: 89 - DNA, 2310 bp, Microbulbifer degradans
atgagaaacactaaacacctactcaatagcggtgccgtattgctagctagcagtattgcaacagctgcgatggcggggcctgtgggctttgcatcgcttaatggtggcacaacgggcggtcaaggcggtcaagttgtatacgccaacaccggtacacaaattaacgaagccatgtgtaaccgcccatctcacgatacgccgttaattatttatgtatccggtaccattaaccacggcaacaccgaaaaggtgtcgggtaattgcgatacaaccggcgacgagattcagtttaaaaaagttaaaaacctatcgttaattggtactggtaacggtgcggtgtttgatcaaataggtattcatttacgcgaaacctccaatattattctgcaaaaccttcatattaaaaatgttaaaaaatcgggttctccaacctccaatggcggcgatgcaattggaatggagtctggcgtatacaatgtgtgggtggatcactgtgagctagaagcatccggtggtgaaaaagatggttacgattcattgctagatatgaaagcaaccacgcagtatgtaaccgtttcttacacctattaccacgattcaggccgcggtggtttaatggggtcgagcgatagtgacgataccaacacctacgtgactttccaccacaattactacaaaaatatggattcacgcttaccgcttttacgccacggtactgcgcatgcctttaacaactattacgatggcattaccaaatctggtatgaacccccgtataggcggtcaaataaaagcagaaaataactatttcgaaaacgcacacaacccaataggtacgttttacacaaacgatatgggttactgggacttaagcggcaatatatttggcaacaacgtaacgtgggcgtctgcggatgatgaaacccctgcagggccgaatccacaatccacaacgtccattcatatttcttacccctacagcttggatgacgcaacgtgcgtgccgaagattgtaaaagctactgcgggtgtgggtaacggtttggctgtgtctaccggtggtagcaattgcggtacttctagctcttcgtctagcagctcttcgtccagctctacctcgtctaccagttctacatctagcagttcttcatcatccaatagttcttctggtggctcaggtgtaaacctttcaattggcgcaggttctgatggtagcagtaaaggtgcgggctcttatggcgatgtgcgcgatggcaatatgagcacctactgggcaccgagtggcagcactggtcgcgtatctattaagtggagttcggcaacgacggtaagtagcattgttattaaagaagcggctggctttgaaggtaacattactggctggcaagttgtaaacaacgagaatggcgcagtattaaaaagcggctctaacgctggcgtaatttctttttctccggtttctactacgaagttaaatttcgaaattacctcttcgaacggcatgcccacggttgcagaatttgaaacctatagcggcacggttggtggtacttcgtcatccagttcttcaagtagttcgtcaagcagttcttcaagcagctcaagttcaacgagcagctctggtggttccgcgaatctaggtacctcggtaagtggcgatcaggtttcacttaattggtctacctcaaacattgatgtgggttcgcagcaagtttatcgcgataccgattcaaacccatctggtcgtgtgcgtatctctgcaggcgtttctggtaattcgtataccgattacggcttagctagcggtacttattactactggataaaaattaccgatcaaaacggtgttgtttacaacacaaatgccgcagaagcggttgtaggcagccaagcgccaacgacgtttactgcgcaagagtctgcgggtttctgctctgttaacggttctgttgattccaataacgctggctacactggcgatggttttgtaaataccgataacgccagtggcaatgcagcagtttatgccttcaatgcacctagtgcgggtatgtatagcttgcaggttcgctacgcaaacggttctagtgcacgcccaggtgatgtgctggtcaacgctggcaatattggaacatttgatttttccagtaccggttcttggacatcttgggcaaacagtaatgagttaagtgcgtacttctctgcgggtaacaatactgttcgtattcaagctactaactctggcggcttacctaacttagatagtgtttctgtaacgggtaatgcaccagcggcaggcaactgtaattaa

SEQ ID NO: 90 - protein, 594 aa, Microbulbifer degradans
MKIFKLLLMFVLAHNLVACGGSNDGGEIELNFGEENTPEPETEPEAEPEGEPEGEPEGEPEGEPEGEPEGETADATADAGFAGHNFNLTGGEGGTAYTVNNGKDLQTVLDNAKSSNSPVIIYVDGTINSFNSANGNQPIQIKDMDNVSIIGYGAEATFDGVGIAIRRANNIIIRNLTFKSVLTEGKDAISIEGDDDGSTTSNIWVDHNEFYSAPTADKDFYDGLIDSKSGASNITISYNYLHDHWKASLHGHTENDEGAHNTDRKITFHHNRFENIESRLPLFRRGVGHLYNNYYKDVGSTAINSRIGAELLIENNVFEDSQNPIVSFYSDVIGYWNTSGNLFTNVTWTTPGTGEVSAGATQTPTSDYVVPYSYTLMPAADVKAHVIASAGVGKIDQTGLTIPDPVTPEGDLGEPEAPVQGDVSLPYTENFAATDAANFFSAAYRDITGSAGTSTPMYHRVTGTVEINAQQLDMTGARVSIGNTTPSVSTTGADTTTTGVLDLSAPYTVSFKVVSVGGTLTKKFQIYVDNNTSASGDSIHGGSSRFYSETLDSLVAGQTYTVTGFTATNSSFITLRTESSGQIVLDDLSIQAAE

SEQ ID NO: 91 - DNA, 1785 bp, Microbulbifer degradans
atgaaaatttttaaattgttattaatgtttgtactcgcccacaacttagttgcttgtggtggcagtaacgacggtggtgaaattgaattaaactttggcgaagaaaacacaccagagccagaaaccgaaccagaagctgagcctgaaggagaaccagagggcgagccggagggagaacctgaaggagagcctgaaggggaaccagagggcgaaacagccgacgcaaccgcagatgctggcttcgccggccacaattttaatcttaccggtggcgaaggcggcacagcctataccgttaataacggcaaagatttgcaaacagttttagacaacgccaaatcgagtaattcaccggtcattatttacgtagacggcaccataaattcgtttaactctgccaacggcaaccagcctattcaaattaaagatatggataacgtatctataattggttacggcgccgaagcaacatttgacggtgttggtatagcaatacgccgcgccaacaacattattattcgcaaccttacttttaaaagcgtccttaccgaaggtaaagatgcaattagtatagaaggtgatgacgacggcagcaccacgtcaaacatttgggttgatcacaacgaattctacagcgccccaacggcagacaaagatttttacgacggtttaatcgatagtaaaagcggcgcgagcaacattactatttcttacaactacctgcacgaccattggaaagcatcgttacacggccataccgaaaatgacgaaggtgcacacaacaccgaccgcaaaattactttccaccacaaccgttttgagaatattgaatcgcgtttaccgctgttccgtcgcggtgtaggccatttgtacaataactactacaaagacgtaggctcaacggctatcaactcacgtattggtgccgagttattaattgagaataacgtttttgaagattcacaaaacccgattgtctctttttactctgacgtaattgggtactggaacacctcaggcaacctcttcaccaatgtaacttggacaaccccaggtactggcgaagtatctgcaggcgcaacacaaacgccaacctcagattacgtagtgccatacagctacacgcttatgccggcagccgatgtaaaagcccacgtcattgcgagtgcaggcgttggcaaaatagaccagacagggcttaccattccagaccccgttacccctgaaggcgacctaggtgaaccagaagccccagtgcaaggtgatgtaagcctaccttacactgaaaattttgccgccactgacgccgccaatttctttagcgccgcgtaccgcgatattactggctctgctggcaccagcacacccatgtaccaccgcgtaaccggcacggtggaaattaacgcacagcaattggatatgactggcgcacgcgtatcaattggcaacacaacgccaagtgtaagcacaaccggtgcagacaccactacaacgggcgtattagatttaagcgcgccctacaccgtaagctttaaagtggtaagcgtaggcggcaccctaactaagaaatttcaaatatatgtagacaacaatacctctgccagcggcgactctattcacggcggctcatcgcgcttttacagtgaaactttagactcgctagttgcaggccaaacctacacagtaaccggctttaccgccaccaacagctctttcataacattacgtaccgaaagtagcggccaaattgtattagatgacctaagtattcaagccgcagaataa

SEQ ID NO: 92 - protein, 425 aa, Microbulbifer degradans
MFKYALYVVALVAGVVVSLAACSKRATQQVETEFYEINERGGDDGRLLRVVNLNNQGVGSLRWALAQTGARKIIFDVGGVIDLEEKSLKIREAHVTIAGETAPSPGITLIKGGLRIETHNVKVSHLMIRPGDAGYSKGQGWKPDGITIYGSKARHVVIDHCSVTWAVDENIAVSGPADKGAEATAGKVLIRNSIIAEALSNASHPEGEHSKGILIHNNVQHVSLVNNLLAHNRRRNPYFKAGTTGIVIGNIIYNPGKRAIHMSSGRADASLPTLSITGNLFIPAANTSPNLSLISNYGKIYSSGNLVQGESRPITDGKSISLTAPPLQQVGINLTDTGTQNDFCQTLSNAGARPWDPDPIDIRIKTQLLAGEGRIIDSQSEVGGYPIHNVNNKETAEAGSTQGDGMLQFDTELLRKIPNLCSGMM

SEQ ID NO: 93 - DNA, 1278 bp, Microbulbifer degradans
atgtttaagtatgcgctatatgttgtggccttggtggctggcgtagtggttagcttagcagcctgcagcaagagagctacgcagcaagtagagactgaattctacgagattaatgagcggggcggagatgatggtcgcctgctacgcgttgtgaatttaaataatcagggggttggctctttgcgctgggcgttggcgcagacaggtgctagaaaaataattttcgatgtagggggggtgatagatctagaagaaaaatcgctcaagattcgtgaagcccatgtgacaatcgctggagagacggccccatcaccgggtatcacccttatcaagggcggactaagaatagaaacccacaatgtcaaagtttcgcaccttatgattaggcctggtgacgcagggtactccaaaggtcaaggttggaaacccgacggcataactatatatggcagcaaagcgaggcatgttgttattgatcattgctcggttacatgggctgtcgacgaaaatatcgcagtatctggcccagcagataagggggcagaggctaccgcgggtaaggttcttattcgcaattcaattattgccgaagcgctaagcaatgcatcccacccagagggggagcattctaagggcatactcatacacaacaatgtgcagcatgtaagcttggttaacaatttgttggctcacaataggcgaagaaacccttattttaaggcgggtacaacgggaattgtaattggcaatataatttataacccagggaaacgtgctattcatatgtcttcgggccgtgctgatgctagcctgccaacactgtcaattacagggaatttgtttattccagcagctaatacttcccccaaccttagtttgataagcaactatggaaaaatttattcgagtggaaacttggtgcagggggagagcaggccgataactgatggtaaaagtatttcattgactgcgccgccgctacagcaagtaggcataaatttaaccgatacaggtacacaaaacgacttttgccaaaccctaagcaacgcaggtgcccgcccgtgggaccccgacccgattgatattagaataaaaacacaacttttggctggcgaaggacgaattattgatagccagagcgaggttggaggctacccaatacataacgtcaataacaaagaaaccgctgaagcaggctctacgcagggggatggtatgttgcagtttgatactgagttattgagaaaaataccaaacctgtgtagtggcatgatgtaa

SEQ ID NO: 94 - protein, 772 aa, Microbulbifer degradans
MRDITMKNNKFRSSFTLKKLTPFFVAGTMLGGSNAWAGCDYTVTNQWGSGFTGNVRITNSGNTPTNGWAVNWQYAGDNRISNSWGAQLSGSNPYSATAESWNAVIQPSQSIEIGFQGTGDGNEIPTINGDVCQTSSGSTSSSSSSSTSSSSSSSSSTSSSSNSSSSSSSSSSSSSSSGSTTGYIHIEENELGFCYVQGSIDSNNGGFTGTGFANTDNVNGSQINWKVNVDFDGYYALEWRYANGSGTARTASVSANGAQSEISFPTTGSWDSWLLDSTTLFLKAGVNDVILSANTSSGLANIDSLTVHGDGVAAADCNTDGSSSSSSSSSSSSSSTSSSSSSSSSSSTSSSSGGPQILKAFPTAEGYGKITAGGRGGDVYIVTNLNDSGAGSLRQAVEASGPRTVVFEVSGTITLNKPLTIKNNNITIAGQTAPGDGITLRKHNFSIQADDVIVRYIRVRFGDETLTDSDAISMRYQKNIILDHVSASWGDDETLSLYHGENITVQWSMITETLNRGGEHAFAAIWGSPFSTFHHNLIAHNVARNVRFASGSGYTDYRNNVVYNWGYSSTHGGEAQQVGNANFNFTTVNMVGNYYKPGPRTESGVRSRLLTPNTRNGDADLGSFYVSGNHMVGSPNVTADNSIGVSNKNALISSPWNSMKIEGEQTAEQAYESVLAYAGASKVRDSVDTRIIEEVRTGTATYGGNGIIESQNEVGGWPQLRSETPPQDSDRDGMPDDWERANNLNPFNAADRNTKDSIGYTMLERYINGLVD

SEQ ID NO: 95 - DNA, 2319 bp, Microbulbifer degradans
atgagagatatcacgatgaagaataataaattcaggtcgtcttttacattaaaaaaactcacaccgttttttgttgcgggcaccatgcttggcggttccaacgcctgggctggctgcgactatacggtcactaatcagtggggctcaggctttactggcaacgttcgtataactaatagcggtaacacgccaacaaatggttgggctgttaactggcagtacgctggcgataatcgtattagtaatagctggggagcacagctttcagggtcgaacccatactctgccacggcagaaagctggaatgctgttattcagcctagtcagtccatagaaattgggtttcaaggtaccggcgacggaaatgaaataccaactataaatggcgatgtttgccagactagcagcggaagtacttcatccagctcatcttcaagtacgtcttctagcagctcttcaagctcgtccactagcagctcttcaaacagctcttctagctctagctcgtccagctcgtctagctcctcctctggctctacaactggatatattcatatagaagagaatgaacttggtttttgttatgtacaaggttccattgactccaacaacggtggctttaccggcacaggctttgccaataccgataacgttaatggctcacagattaactggaaagtaaatgtcgactttgatggatattatgcgctcgaatggcgctatgcgaatggctccggcaccgcgcgcactgcaagcgttagcgctaatggagcacaaagcgaaatttccttccctacaacaggttcgtgggatagctggttattagacagcactaccctatttttaaaagctggcgtaaacgacgtaatattgagcgcaaatacaagcagtggcctagcgaacatagattcacttacagtgcacggtgatggcgtagctgcggcagactgtaatactgatggaagctcaagcagcagctctagttcaagctctagttccagctcaacttctagtagctcctcaagttccagctcgtctagcacgtccagctcttctggtggcccgcaaatattaaaagcattccccaccgcagaaggctacggaaaaataaccgcaggtggtcgtggtggcgatgtctatatagttacaaacctgaatgactcaggcgcgggtagtttgcgtcaggccgtagaggcatctggccctagaaccgttgtgttcgaagtgtctggaaccatcactctaaataaaccactcacaatcaaaaataataacatcacaatagcaggacaaactgcaccaggcgatggcattacacttagaaagcacaacttttctatccaagctgatgatgtcatcgtacgttacatacgtgttcgctttggtgatgaaaccctaaccgattctgatgcgatttccatgaggtaccaaaaaaatattattttggatcatgtgagtgctagctggggagatgatgaaaccttatctctttatcacggcgaaaatatcactgtgcaatggagcatgattacagagaccctcaatcgtggcggcgaacatgcattcgcagctatatggggttcgccttttagtaccttccaccacaatttaattgctcacaatgttgcgagaaacgttcgctttgcgtcgggttccggttatacggattatcgtaacaatgtcgtatataactggggctatagcagcacacacggaggcgaagctcaacaagttggcaacgctaattttaatttcaccaccgtcaatatggtcggcaactattacaaacctgggccgagaactgaatctggcgttcgtagtcgactacttacacctaacacgcgtaacggcgatgcggacttaggtagtttttacgtttctggtaaccacatggttggcagcccaaatgtaactgcagacaactcgattggcgtatcgaataaaaatgccttaataagtagcccttggaattcaatgaaaatagaaggcgaacaaacagctgagcaagcatatgagtcagttcttgcttacgcaggtgcatctaaagtacgcgactcggtagatactcgtattattgaagaagtacgtacaggcacagctacttatggtggaaacggcataattgaatcgcagaatgaagtgggtggttggccacaacttagaagtgaaacgcccccgcaagacagtgatcgcgacggaatgccagatgactgggaacgcgcgaacaacctaaatccattcaacgcagccgatagaaacactaaagacagtattggctacacaatgttagagcgatatattaacgggcttgttgattaa

SEQ ID NO: 96 - protein, 511 aa, Microbulbifer degradans
MLRIPKAWLALPLVLGSTNLYAQVTCSISNTNVWNNGYTVNVNVTNTGSSQVGSWQVPINFSEPPQVSSGWNAILSTNGNTVTAGNIGWNGNLNPGQSASFGFQGGHDGSFVEPTCSGGGSSTSSSSSSSSSSTSSTSSSSTSSSSSSSSGGSELLIQENASGFCRVDGSIDNNNSGYTGSGFANTENQNGSAVEYALNVPSNGNYLLDARYASATTRSASVVVNGSSVGSFSFPSTGSWTSWTVDSANVPLKGGNNIVRIVATNSSGLPNIDSLKVIGTNPSAGSCSSNSSSTSSSSSSSSSSSNSGGKGSSCRSTGSQSVSSTIKVTSGTFDGNCKTYNPTSALGDGSQSESQKPAFRVENGATLKNVILGNNGVDGIHVYNGGTLDNIRWTNVGEDAMTVKSEGNVTVSNIEGYDGSDKFIQVNAVTNLKVSNCIVDKMGKFLRQNGGKTFAMSVTVDNCDISNMGEGVFRSDSPNATARITNSRLKNAGDICIGKWKSCTSSNITSF

SEQ ID NO: 97 - DNA, 1536 bp, Microbulbifer degradans
atgttgcgaatccccaaggcttggctggcacttccacttgtactgggaagtaccaatctatacgctcaagtaacttgcagtatctctaacaccaatgtttggaataacggatacaccgttaatgttaatgtaaccaacacaggctcttcacaggttggttcttggcaggttcctattaatttttctgagccacctcaagtaagcagcggctggaatgcaatattaagcacaaacggaaacaccgtaactgccggcaatattggttggaatggtaatttaaatcccggccaaagcgcctcctttggttttcaaggtggccacgatggcagctttgtggagcccacctgctcgggcggaggctctagcactagctcaagcagctctagtagttctagctcaacaagttctaccagttcttcatccacaagttcaagtagctcttctagctccggcggctctgaacttttaatccaagaaaatgcatccggcttctgccgtgtggacggatcgatagataacaataactcaggctataccggtagtggctttgccaacaccgagaaccaaaacggttccgcagttgaatacgcacttaacgttccctctaatgggaattatctcctcgacgctcgatatgcaagcgctactacacgatcggctagcgtggtagttaatggatcttcagtaggcagctttagttttccatctacgggttcgtggacaagctggacagttgactccgccaacgttccgttaaaaggcgggaataatattgttcgaattgttgcaactaacagcagcggattacctaatattgattcattaaaggtaataggcaccaacccgtcagccggcagttgttcaagcaactcgtcatccactagttcatcgtctagctcaagttcatcaagcagtaactccggtggcaaaggctctagctgccgttctacaggcagtcaatctgtttcctctactattaaagttactagcgggactttcgatgggaactgtaaaacgtataaccctacaagtgcccttggcgatggcagtcaatcagaaagccagaaaccggcattccgagtggagaacggcgcaacactcaaaaacgtgattctaggcaacaatggcgtagacggtattcatgtttataacggcggcaccttggataacatccgctggaccaatgtgggtgaagatgcaatgaccgttaaatctgaaggaaacgttaccgtttcaaatattgagggttatgacggttcagataaatttatacaagtaaacgcagttaccaacctaaaggtttctaattgcattgtagataaaatgggtaaatttttacgtcagaatggcggtaaaactttcgctatgtctgtaaccgtagataattgtgatatctcaaatatgggtgaaggtgttttccgctcagacagcccaaatgcaacagcgagaatcacaaatagccgattaaaaaatgcaggcgacatttgtattggtaagtggaaaagctgcacatcttccaacattaccagcttctaa

SEQ ID NO: 98 - protein, 455 aa, Microbulbifer degradans
MIMMRNKILLALVLCGASASAFAASNRPSGYTTICKTDQTCSVSSSTNVAFGAAGKFVYKVINGTFTCNTSTFGSDPNPAKSVKECSVPTNGSSSTSSTSSSSSSSSSSSSGSSSSCGTGGGATVCLSAGGGSNDIDLTWTVSGSISSAQVYRDTDSNPSGRTRIAQLGGDARSYSDTNVSAGKQYYYWIKFGANGSNYNSNAASATYSGSSSSSSSSSSSSSSSGGSAECKAGATISGKTVDCGGKEIGLSCSGDSETQPPVLTLKNATIKNLVISAKGGSDGIHCTGNCTMENVVWKDICEDAATNKTDGITMTIIGGSAYNSTSGYGGKPDKVFQHNSKNSTTVIKGGFTLTGEHGKLWRSCGNCTNNGGPRNVTIDNVKVDAKIGSIVGVNRNYGDKATIKNLKIKDYKSGSPKVCEEYKGVQKGSGESSKYGEYWDTANCDVSKSDVSAL

SEQ ID NO: 99 - protein, 60 aa, Microbulbifer degradans
MPHELLEPDELLELELEELLVLLVLEEPLVGTEHSFTDLAGLGSLPKVDVLQVKVPLITL

SEQ ID NO: 100 - DNA, 1368 bp, Microbulbifer degradans
gtgataatgatgcgtaataaaatcctattggcgcttgtattgtgtggagcttctgcctctgcctttgcggctagtaatcgtcctagtggttacacaactatctgtaaaaccgatcaaacttgttctgtaagctcgtctaccaacgttgcgttcggcgctgctggtaagtttgtttacaaagtaattaacggtacctttacttgtaatacatctacttttggcagcgatcctaaccctgctaaatctgtaaaagaatgttctgtacctactaatggttcttctagcactagcagcaccagtagttcttctagctctagttcaagtagctcatcgggttcaagcagctcatgtggcactggtggcggcgcaactgtatgtttaagtgcaggtggcggcagtaacgatatcgatttaacttggacagtatctggttctatttctagcgctcaggtttaccgcgacacagattctaaccctagtggtcgcacacgtattgctcaattaggtggcgatgcaagaagctatagcgatacgaatgttagtgctggtaagcagtactactactggattaagtttggcgccaacggctctaactacaattcgaatgcggcttctgctacctatagtggttcaagtagctcatcgagttcttcaagctcttctagttcctcatctggcggctcggctgaatgtaaagctggcgctactatttctggtaaaaccgtagattgcggtggtaaagaaattggcttgtcgtgctcgggtgatagtgaaactcaaccaccagtattaacgcttaaaaatgccaccattaaaaacttggtaatttctgctaaaggtgggtccgacggtattcactgtactggcaactgcaccatggaaaatgttgtttggaaagatatctgtgaagatgctgctaccaacaaaaccgacggtattaccatgaccattattggtggtagtgcgtataactctacaagcggttacggcggcaagccagataaggttttccaacataactctaaaaacagtactactgtaattaaaggcggctttacattaacaggtgagcacggcaaattgtggcgttcatgtggtaactgtactaataacggcggcccacgtaatgtgactatcgacaacgttaaagtagacgcgaaaataggcagtattgttggcgttaaccgcaactatggcgataaggcaacaatcaaaaacttaaagattaaagactacaaatctggtagccccaaagtgtgtgaagaatacaagggtgtacaaaagggtagtggcgagtcttctaagtatggcgaatactgggatactgcaaactgcgatgtaagtaaatcagatgtgtctgctctttaa

SEQ ID NO: 101 - protein, 424 aa, Microbulbifer degradans
MFNKILVAVGLLAASLSVHAATNRPSGYTTICKVGETCSVSQSTNVAFGASGQFVYKVLNGSFSCSVSTFGSDPIPSKSVKECSIPSNGSSSSGSSSSSSSSSSGSSSGGGCGSGGGSTVCLSASGSSNGINLSWSVSGSISSVQLYRDTDSNPSGRTRIASVSSSTTSFSDTGAASGTTYYYWVKYYVNGTAYNSGVASAVRGSSSSSSSSSSSTSSSSGGKGSSCSSTGSQSVSSTIKVTSGTYDGGCKTFNPTSALGDGSQSESQKPAFRVENGATLKNVIIGNNGVDGIHVYNGGTLNNILWTNVGEDAMTVKSEGNVTVTNVEGYDGEDKFIQVNAVTNLKVSNCIVNKMGKFLRQNGGKTFAMSVSVDNCDISNMGEGIFRSDSPNATAVITNSRLRNAGDICIGAWKSCKSSNISSF

SEQ ID NO: 102 - DNA, 1275 bp, Microbulbifer degradans
atgtttaacaagatactcgttgcagtaggattacttgcggctagcctttctgtgcacgccgcaacaaaccgcccaagtggttatacaacaatttgtaaggttggtgaaacatgctcggtaagtcagtctacgaatgtagcctttggcgcgtctgggcagtttgtgtataaagtattaaacggtagcttttcttgtagtgtttctacgtttggtagtgaccctattccttctaaatctgtaaaagaatgttcaatcccatcaaacggctctagctcttctggctcgtcttcatcttcgtctagcagctcttccggtagctcttctggtggtggctgtggcagcggtggtggttctacggtgtgcttatcggcctcgggttctagcaatggtatcaatttaagttggtctgtatctggttctatatcttccgtgcagctttatcgcgataccgattcaaacccaagcggtcgcacgcgtattgctagtgtatctagctctactactagctttagtgataccggcgcggcatcgggcaccacttattactactgggttaaatattatgtaaatggtactgcttacaactcgggtgttgcttctgcggtgcgcggttcttctagctctagtagttcaagttcttccagcacttctagcagttctggtggaaaaggttctagttgtagctctactggtagccaatctgtgtcttctactattaaggtaaccagcggtacttacgatggtggttgtaaaacatttaaccctaccagtgctttgggtgatggtagccaatctgaaagccaaaaacctgctttccgtgtagaaaacggtgcaacgttaaagaatgtaattattggcaataacggtgtggatggtattcacgtttacaacggcggtacgttaaataatattctttggactaacgtaggtgaagatgccatgaccgttaagtctgaaggtaacgtgacggtaaccaatgttgaaggctatgacggcgaagataagtttattcaggtaaacgcagtgactaacttaaaagtttctaactgtattgtgaataaaatgggtaagtttcttcgtcagaatggtggtaaaacatttgccatgtcggtaagtgtagataactgcgatatatctaatatgggtgaaggtatcttccgttcagacagcccgaacgctacagcggttattactaacagccgtttacgcaacgctggggatatttgtattggggcttggaaaagttgtaaatcttccaatatcagcagcttttaa

SEQ ID NO: 103 - protein, 392 aa, Microbulbifer degradans
MKKLILMVALLAFSVSSFAALSSGRYIIVSKLNGNALDVDSFSTADGANVMQWFALGGVNQQFDVAVLSDGSYSIRPVHSGKSLDVYAWNADDGAELRQWAYTGADNQRWYIDNQSGDYYSITSKFSGRALDVWGMSMYTGADVRLYSYWGGAGQLWTFQKVGSSSECYAGATLTNRFVDCGGKTIGLSCVGDSETQGAVLTLKNSSIRNVKLAANGGADGIHCTSGNCTLADVVWNDICEDAATNKSEGGTLTIVGGSAYNSTGGYGGTPDKIFQHNSKNSTTIVAGGFTAYGTHGKLWRSCGNCTNNGGPRNLLVYSVNIDASIGAIAGVNRNYGDRATIRDLKIKNYSSGSPHVCDEYQGVQKGNSSTKYGEYWNTASCDVSRSDVSGL

SEQ ID NO: 104 - DNA, 1179 bp, Microbulbifer degradans
atgaaaaaacttatccttatggtggcgctgttggcttttagtgttagttcttttgctgcactgtcttcaggccgctacattattgtttctaaacttaatggcaacgcgttagatgtagatagctttagcaccgcagatggcgccaatgttatgcagtggtttgctttgggtggtgtgaaccagcagtttgacgtggcagtgcttagcgatggcagttactccatacgaccagtgcacagcggtaagtcattagatgtatatgcgtggaacgcagacgatggtgcggaacttcgtcagtgggcatacacaggcgcagataaccaacgttggtatatcgataatcaaagtggcgattactattcaattacgtctaaatttagcgggcgcgcattggatgtatggggtatgagtatgtacaccggcgcagatgtccgcctttattcatattggggcggcgcggggcagctgtggaccttccaaaaggtaggtagctcaagtgagtgttacgcaggtgctacgttaacaaaccgctttgtggattgtggcggcaaaacaataggccttagttgtgtaggcgatagtgaaactcaaggcgcggtgctaacccttaaaaactcgtccattcgcaatgttaagttggctgcaaacggtggtgcggatggcattcactgcactagtggcaactgcacattagccgacgttgtttggaacgatatttgtgaagatgctgccacgaataagtctgaaggtggcaccctgactattgtgggtggttcggcgtataactctactggcgggtatggtggtacaccggataaaatttttcagcacaactcgaaaaacagcacaacaattgttgccggcggcttcactgcatatggtacccacggtaagttgtggcgctcgtgtggtaactgtacaaacaacggcggtccgcgtaatttactggtttatagcgtgaatattgacgcaagtattggcgcaattgctggtgttaaccgcaattacggcgatagagcgaccattcgcgacctaaaaataaagaattattcttctggcagcccgcatgtgtgtgacgaatatcaaggcgtacagaagggcaattcttctacaaaatatggcgagtactggaataccgcaagttgtgatgtttcgcggtcagatgtaagtgggctttaa

SEQ ID NO: 105 - protein, 733 aa, Microbulbifer degradans
MFRYILTAFALVAAASCAQAATNRPSGYTTICKTNQTCSVSSPTNVAFGASGKFTFKVLNGSFVCSVATFGSDPNPAKSAKECSIPSDGSSSTSSTSSTSSSSSSSSSSTSSSSSSSSSSSSSSSSSSSSSSSGSSQAGCGSGGGATVCLSATDTASAINLNWTVSGSLSSVQVYRDTDPNPSGRTRLTSLSPSVTSYTDNNAQAGTTYYYWIKFGANGSNYNSGAASAVIANTGNDDEGCGSDVCLTATANIGSIGLSWGSSAALTSVQIYRDTDSNPSGRTRIASLSTSATSFTDSTTAVGTTYYYWVKYGLNGSQLNSNVASATALQNNTGNASCPGETSGETAATVYYVTPNGSASASGNSFASAMDIDTALSIVGAGQMILMQPGTYTVAYSAGNKNTKVLSRSGAAGAPIKMVAANCGRAVFDFSFPEREWVQDSYGFFLTGDYWYFKGIEITRAGYQGVYVTGAHNTFENCAFYYNRNTGLEINKGGSYTTVINSDAYRNYDPKKNGSMADGFGPKQTQGPGNKFIGCRAWENSDDGFDLYDSPEEVTIENSWAFRNGVDVWGYGGFAGNGNGFKLGGNHVAANNRITNSVAFGNPVKGFDQNNNAGGITVLNCTAYANGTNYGFGNNLNSGEQHYFRNNVSVSGAVNISNADNKYNSWNGGVTASTADFENVDLSKATAARNIDGSLPNNGLFRLKSGSDLIDAGVEVGLPSNGSAPDMGAFEAN

SEQ ID NO: 106 - DNA, 2202 bp, Microbulbifer degradans
atgtttcgatacatccttactgctttcgcattggtggcagcggcttcctgcgcgcaagcagctaccaatcgccctagcggttacaccaccatatgtaaaaccaatcaaacctgctctgtttcaagccctaccaatgtggcgtttggcgcatcgggtaaatttacctttaaagtgcttaatggctcttttgtttgtagcgtagccacttttggctccgaccctaacccggctaaaagtgctaaagagtgctctattccgtcggatggctcttccagcacctctagtacttcgagcacatcgtctagttctagtagttcatctagcagcacaagttcaagcagcagctctagcagttcttctagctcttcgtcttccagtagctcaagttctagttcaagtggctcttcgcaagctggctgcggtagtggcgggggagcaacggtttgtttatcggcaaccgatacagctagtgctatcaatttaaattggacagtgagtggctcgctgtcgagcgtgcaggtgtatcgcgataccgatcccaacccaagtggacgtacgcggttaacgtcgttaagcccttcggtaacaagctacaccgacaacaacgcacaggccggtacaacctactattactggattaaattcggcgcaaacggcagcaactataattccggtgctgcgtcggctgtaatagccaataccggtaacgatgatgaaggttgtggtagtgatgtgtgcttgacggcaaccgctaatattggctctataggcttaagctggggctcttctgccgctttaaccagcgtacaaatttatcgcgatacagattcaaacccaagtgggcgtacacgtattgcatcgcttagcacttctgcaaccagctttaccgattcaaccactgcagtaggcacaacgtattattactgggttaaatacggcttaaacggcagccagctaaactctaatgttgcatctgccactgctttgcaaaataacactggcaacgcaagttgccccggtgaaacaagtggcgaaactgcagcaaccgtgtattacgtaacaccaaacggttcggctagtgcaagcggcaatagctttgcatctgcaatggatatagacacagcactttcaattgtaggcgcggggcaaatgatattaatgcagcctggtacctacaccgttgcctatagtgcgggtaataaaaataccaaagtgctttcgcgctcgggtgccgctggtgcacctatcaaaatggtggcagccaattgcggtcgtgcagtgtttgatttttcgttcccagaacgtgagtgggtgcaagattcttacggctttttcttaactggcgattactggtattttaaaggaatagaaattacccgtgcaggctaccaaggtgtgtatgtaacgggtgcgcacaacacatttgaaaattgcgccttttattacaaccgcaatacaggtttagaaattaacaaaggcgggtcttacaccaccgtcattaattcagatgcctatcgcaattacgatcccaagaaaaacggcagcatggccgatggctttggccctaaacaaacccaaggcccaggcaataaatttattggttgccgcgcgtgggaaaactccgacgatggatttgacctgtacgatagcccagaagaagtaactattgaaaatagctgggcatttcgcaacggtgtagatgtatggggttacggtggttttgcgggtaatggcaacggctttaaattgggcggtaaccacgtggctgcaaacaatcgtattaccaactcggttgcgttcggcaaccccgtaaaaggttttgatcaaaacaataatgccggcggtattacagtgcttaattgcacagcctacgccaacggcactaactacggctttggcaacaacttaaactcgggtgagcaacactacttccgcaataatgtttctgtatctggcgctgtgaatattagcaatgccgacaacaaatacaattcgtggaacggcggagtaacagcatccacggcagattttgaaaacgtagatttatccaaagccaccgctgcacgtaacatagatggcagcctgccaaacaacggcctattccgcttaaaaagcggcagcgatttaatagacgccggtgtagaggtaggtttaccaagtaacggcagcgcgcccgatatgggagcgttcgaagctaactag

SEQ ID NO: 107 - protein, 700 aa, Microbulbifer degradans
MKNVFNTQKTKRHCNYAYNAKAAKPFSQKALVQKCAAAALSVGLLGAVGNAYAISCSATADTWGGGYVLNVTVTNDTNNAISNWALALNYDQAAAITNSWNASVSANGNVVNATNIGWNGNLAAGQSTSFGLQGTYTGNFSLPVCVGQGQSSSSSSSTSSSSSSSSSSSSSSSSSSSSSSSSSSSSSSSSSSSSSSTSSTGGSSELTIQEDNSGFCGVDGSIDSNNSGFTGSGFANTDNATGKSVDWSVSVPYSGNYLLEWRYANGSGNNRAGAIEVNGNARGNQSFPTTGAWTSWTTASANVSLDAGTNLISLVASTGEGLGNIDSLTVIGNDIQTGACDSTGSSSSSSSSSSSTSSSSSSSSSSTSSSSSGAPMLPQAGNPINGKFGKYKSWQKGSLSADKQFADILLSHQYTNGGFPKNQAYDSMGSGGNSAGTIDNDATTTELLFLADVYQRTGETKYRDGARKALDFLLDMQYSSGGWPQYYPVRSGYYEHVTFNDDAMARVLIVLDKAKQGVAPLNGDLLTSNQRARLSSAVNKGVDYILKSQWRQNGTLTVWCAQHGKDDYLPKKARAYELESLSGSESVLVVAFLMSQPQTPEIKTAVKAAINWFRSPNTYLAGYTYDSSRKGDGNSPIVAKSGSKMWYRFYDLNTNRGFFSDRDSRKVYDILDISTERKDGYRWGGDYGSGIISYAESVGY

SEQ ID NO: 108 - protein, 72 aa, Microbulbifer degradans
MVNSLLPPVELVDEDDELEDEELLELLEELLEELEDELLDELEELDELLLVLLLEEELWPWPTQTGKLKLPV

SEQ ID NO: 109 - DNA, 2103 bp, Microbulbifer degradans
atgaaaaacgtatttaatacacaaaaaaccaagcggcattgcaactatgcctataacgcgaaagctgccaaacccttcagccaaaaagcactggtacaaaagtgtgcggctgcggcattgtctgttggcttactgggggccgtgggtaatgcgtatgcaatatcctgttcggcaactgctgatacctggggtggtggctatgtgctaaatgtgaccgttactaacgacacaaataatgcaattagcaattgggcgctagctttaaattacgatcaagctgcagccataactaattcgtggaacgcgagtgtgtctgcaaatggcaatgtggttaatgctaccaacattggttggaatggcaatttagcggctggccaaagtacaagttttggtttgcaaggcacctataccggcaactttagtttacctgtctgtgttggccagggccaaagctcttcctctagtagcagtactagtagtagttcgtccagctcttcgagttcatccagcagttcatcttccagctcttcaagtagttcttcaagcagctctagtagttcttcatcttctagctcatcgtcttcgtccaccagttcaactggtggaagtagtgagttaaccattcaagaagataatagcggcttttgcggggttgatggttcaatcgattccaataattcaggctttaccggaagcggcttcgccaataccgataacgcgacaggcaaaagcgtagattggagtgtgagcgttccttatagtggcaactatttgcttgaatggcgttacgcaaatggttccggtaataaccgtgctggcgcgattgaagtaaatggtaacgctcgtggtaatcaaagctttcctactacaggggcctggactagctggacaacggcaagtgctaacgtaagtttggatgcaggtacaaacttaattagcttggttgcatctacgggcgaaggcttagggaatattgattcacttactgtcattggtaacgatattcagaccggcgcttgtgattctacagggtctagctcttccagtagctctagttcctccagtacttctagctcaagttccagctccagttcaagtaccagtagttctagcagcggtgcgcccatgttacctcaagctgggaaccccattaatggcaagtttggcaaatataaatcttggcaaaaaggaagcttgtctgccgataagcaatttgcagacatccttctatcgcaccaatataccaatggcggatttcccaaaaaccaagcctacgacagtatgggtagcggtggtaacagtgcgggcacaatcgacaacgatgccacaacaacagagttgttattcttagctgatgtgtaccagcgtactggtgaaaccaaataccgagacggtgcgcgtaaagcgttagatttccttttggatatgcagtattcatcgggcggctggccgcaatactaccctgtgcgcagtggctactacgagcatgtaacatttaacgacgatgcaatggcgcgagtgctaattgttttagataaagcgaaacaaggtgtggcgccgctaaatggcgatctattaacatctaaccagcgtgcgcgtttaagcagtgcggttaataagggcgtggattacattcttaaatcgcagtggcgtcaaaacggaaccttaactgtttggtgtgcgcaacatggtaaagatgattatctacctaaaaaggcgcgtgcttacgagctggaatcgttgagtggtagcgaatcggtattggtagttgcattccttatgtctcaacctcaaacccctgaaattaaaacggcggttaaggctgctatcaattggtttagaagccccaatacttacttagctggttacacttacgattcatctagaaaaggcgacggcaacagccccatcgtcgcgaaaagcggtagtaaaatgtggtatcgcttctacgacctaaatactaaccgtggcttcttcagtgatagagatagcagaaaagtttacgatattttagatatttctacagagcgtaaagatggctatcgttggggcggtgattatggctccggcatcattagttacgcggaaagcgttggttactaa

SEQ ID NO: 110 - protein, 96 aa, Microbulbifer degradans
MSVPALPPEELLELEDELLELEDELLELDELLELDELLELVELLELEELVEAFISLAGPELPPPQALNSVAASASVIRRRKFIIVALYVFILRAHK

SEQ ID NO: 111 - protein, 574 aa, Microbulbifer degradans
MNFLRLITLALAATLLSACGGGSSGPAKEINASTSSSSSSSSTSSSSSSSSSSSSSSSSSSSSSSSSSSSSSSSSGGSAGTLTIQESEKGFCTVNGEIVNNHEGYSGTGFVDTANAEGASITWKVDVDGGNYDVSVRFANGSTARGATLSSNEINTTYGFATTGDWATWADETHTVSLAAGENTIQLSALTAGGLPNVDAITIAGAGVLAADCATEHTGPMLSQTGNPIYTELNNYKSWLTGSGTTAAKLAADKTIADNMITWQMPHGGFYKYGVSKYSSAWNGSDARSGWTGANGVELGTIDNDATVSELLFLADVYKRSGETKYRDAARSALEFLLTMQYSTGGWPQVYPARTGTSYSNHVTFNDNAMARVLILLDKAARLEAPLDGDIFTTDQHTRITTAINGGIDFILNAQIVQGDVKTVWCAQHDPYTYEAKAARSYELASKSGKESVLVVAFLMTRPQSEAIENAVKAALAWYRNPNVQVANTEYVKRTNNDDNYNPIQTKAGSTMWYRFYDLDQDVGFFSGRSASDNPAGNGKQYDIMLIEPERRYGYEWGGNYGKKIIDYANSVGY

SEQ ID NO: 112 - DNA, 1725 bp, Microbulbifer degradans
atgaattttctacgccttattacactcgcactcgccgcaacactattaagtgcctgcggtggaggtagttctggcccagccaaagagataaacgcttccaccagttcctctagctctagcagctccacgagttctagcagctcatccagctctagtagttcgtctagctcaagcagctcgtcttccagttccagcagctcatcctctagctctagcagctcttctggtggtagcgccggcacactcactattcaggaaagcgaaaaaggcttttgcactgttaacggtgagattgtgaataatcacgaggggtatagcggtacaggttttgtagacaccgccaatgccgaaggcgccagcattacttggaaggtagatgtcgatggcggcaattatgatgtaagtgtgcgattcgcaaacggttccactgcacgcggcgcaacgcttagcagtaacgaaataaataccacctatggttttgctaccactggcgactgggccacatgggcagacgaaacccacaccgtttcgttagccgcaggcgaaaacaccatccagctaagtgcacttaccgcgggtggcttacccaatgtagacgctattactattgcaggtgcaggtgtactcgcagcagactgcgccacagagcatactgggccaatgctttcgcaaacaggcaaccctatttataccgagttaaataattacaagtcctggctaacgggtagcggcacaacagcagccaaattagccgcagataaaacaattgccgacaatatgattacctggcaaatgcctcacggtggtttttataaatacggcgtatctaaatacagctcggcttggaacggtagcgatgcccgctctggctggactggggccaacggcgttgagcttggcacaattgataatgatgcaaccgttagcgaattattatttttagcggacgtatataaacgcagcggtgaaactaaatatagagatgccgcaagaagcgcgttggaatttttacttaccatgcaatattccactggcggttggccacaggtttaccctgcgcgcactggcaccagttactccaatcacgttacgtttaacgataacgccatggctcgtgtacttattttattggataaagccgcgcgattagaagcaccactcgatggcgacatttttaccacagaccagcacacgcgtattactaccgcaataaatggcggcatcgattttattttgaatgcgcaaatagtacagggcgacgtgaaaaccgtttggtgtgcgcaacacgacccttatacctacgaggcaaaagcagctcgctcttatgagttggcctctaaaagcggtaaagaatctgtattggttgtagcgtttttaatgacacgcccgcaaagcgaagccatagaaaatgccgtgaaagcagcccttgcttggtaccgcaacccaaatgttcaagtcgccaacaccgagtatgtaaaacgcacaaataacgatgacaactacaacccgatacaaacgaaagcaggtagcactatgtggtaccgcttttacgatttagaccaagacgttggattctttagcggccgctctgcaagtgacaacccagcaggtaacggtaagcaatacgacattatgcttattgaacccgagcgcaggtatggctatgaatggggtggcaattacggcaaaaaaataatcgattacgctaattcggtagggtattaa

SEQ ID NO: 113 - protein, 463 aa, Microbulbifer degradans
MYKISRRTTLKGLGLTCLAGCTTSLPTLEQDPWAFAQNIADNTTIPTFPNKEFNLLEFGGKEGSDNTLAFKKAIAACSKAGGGKVVVPAGRFETGAIHLESNVNLHISEGATIAFFTDPKYYLPAVFTRWEGMECMGYSPLIYAYGKTNIAITGKGTLDGQADPTHWWAWKGNKEWGVEGYPSQKESRNQLFAQAEAGDPVRERVYADGHYLRPSFVQPYKCENVLIEDITIINAPFWLLHPTLSQNVTVRGVHLESLGPNSDGCDPESCKNVVIENCFFNTGDDCIAIKSGRNNDGRRLATPTENVIIRNCKMEAGHGGVVIGSEISGGVRNVFAENNVMSSPDLEKGIRIKTNSVRGGLLENIYVRNCTIGEVQQAIVINFQYEEGDAGKFDPTVRNVEIRNLVCQHALQVFNIRGFERAPIQNFRIIDSTFVRGDNPGVIEHTTGLVIDNVQVNGKAFNI

SEQ ID NO: 114 - DNA, 1392 bp, Microbulbifer degradans
atgtataaaatttcacgccgcacaacactcaaaggcttaggcctaacttgcctagccggctgcaccaccagcctacccacactagagcaagacccatgggcttttgcacaaaacatagcggacaacaccaccatccccacattcccaaacaaagaatttaatttactcgaattcggcggcaaagaagggagcgacaacaccctcgccttcaaaaaagcgattgcagcatgcagcaaagcaggtggcggcaaggtggtagtacccgcaggacgatttgagacaggcgccatccacttagagtcgaacgttaaccttcatattagcgaaggcgctaccatcgccttttttaccgaccccaaatattacctgcctgcggttttcactcgctgggaaggcatggagtgcatgggctactcaccccttatatacgcctacggcaaaaccaacatagccattaccggtaaaggcaccctcgacggtcaagccgacccaacgcactggtgggcatggaaaggcaacaaagaatggggcgtagagggctacccaagccaaaaggaaagccgcaaccaactatttgcccaagcagaagctggcgaccccgttagagagcgcgtgtatgcagacggccactacctgcgcccctcgtttgtgcaaccctacaagtgcgaaaacgtgctgatagaagacataactattatcaacgctcccttctggttgctacaccccaccctttcacaaaacgtcactgtacgcggtgttcacctagaaagcctaggccccaactcggatggctgcgatcctgaaagctgtaagaatgtagttatcgaaaactgcttttttaataccggtgacgactgtatcgctattaaatctggccgcaacaacgatggccgcaggcttgccacacctaccgagaacgtgattattcgcaactgtaaaatggaagcgggtcacggtggcgtagttataggctcagaaatttctggcggcgtgcgcaatgtgtttgccgaaaataacgtaatgagcagccccgatttagagaaaggcattcgcattaaaaccaactctgtgcgcggcggactgctagagaacatctatgtgcgcaactgcaccataggcgaagtacaacaagccattgttattaacttccaatacgaagaaggcgatgcgggtaaatttgaccccaccgtgcgcaatgtagaaatacgcaatttggtctgccagcacgccttacaagtgtttaacatccgcggttttgagcgcgcccccattcaaaactttaggataatcgacagcacctttgtgcgtggtgacaacccaggcgtaattgaacataccacagggttagttatcgacaacgtccaagtcaacggcaaagcgtttaacatctag

SEQ ID NO: 115 - protein, 1084 aa, Microbulbifer degradans
MLDMTKRTLSALLALCATLTACGGGDITSGGDAIPAVNQPAPVQEPEPEPEPQPEPEPEPEPEPEPEGAWTCPETGFYFCDDFEDGTFDDKWDDLIATYDLPSPGVFDILDEASGKSLRFTAGTRGGDLADGELIVVKDTAFENVTNADYSLEYRIRPRNNGNTGNKYLHAMSRYEGPKEYYFGGLSMQGSTASTQVEAGFVLPENTTSISNRLVQAKYPLELGTTGMSDGYWYEVRFDMIGNTGTIYLDGEPQGSFTDADGLYPLTGKIGFMTYNRSFEIDWVRVGDPAIKPVQLSLDYASPLWEAAADQDPLNVTVTAIQSDGVTADTFTAVSSDTNVVTTSIANNVVTITPVAQGSATVTFTAGSDANRVKTIDVEIARAFVMSTTDYGDIASKVTPTVGMTDANPDAHLSITFDSAPTLSGVGSIRIYNAADDSEVDVIRLTDESDALGYAGQANKRELNTTPVYLDGNTLHVSPHSNALAYGQDYYVAIGDNVLTGATLNTIAFDGLGKNAGWTFSTKASAPTGNTVTVDDDASADFSTVQGALNYAMANTTDDSITINIANGNYYEPLYLAERNNVTLKGESRDGVVIHYNNHEAMNGGSTGRANFYVANSDMLTLETLTLKNGHQRTGGGDQAETIYFNSSSNTDRLIAKGAAFISEQDTLLLKGYNWFYNSLVVGNVDFIWGYSAVTLFEETEIRSIADSKPGAGDSGGYILQARTPLETDLGFVFLNSELTKATGVNGNEIGDGKTYLARSGGSTGYFDNISFINTKMGSHIADIGFAYADINGQPAPNPAVATADAGWREFGSMDSAGTALDVSARCGDSGSCIQLTQAQVDAQYCNRAQIFASWNDWTGWDPLPEDTSDDACADPVIPGAVTWTGIAMSLGGSTTSVSGNITEQTDSNITFTADGGKFESSKLSTYFAYQELTGDFVISAKAKTIGLLRENGSYQFPTGILMCVCDAAAATTGLMGHASLNDITVDTTVNLVATYGHIQTTAGSWNKTGTTDVTAGDNLYIQLERAGNSYTARYSTDGGATYSNIGGSSFTDTLPDTLKVGFFATPNNTGEQTFVYEDIQITQ

SEQ ID NO: 116 - DNA, 3255 bp, Microbulbifer degradans
atgctcgatatgacaaaacgaactctatctgcgttgttagccctgtgcgcaacattaacggcttgcggtggtggcgatataaccagcggcggcgatgctataccggcagtaaaccaacccgccccagtacaagagcctgaacctgaacctgaaccacaaccggaacccgaacccgaacccgagcccgagccagaaccagagggcgcgtggacctgcccagaaacaggcttctacttctgtgacgactttgaagacggcacgtttgatgacaagtgggacgatctcattgccacatacgacctaccaagccctggtgtattcgacatattagacgaagcaagcggcaaatctttgcgctttacagcaggcacccgtggcggtgacttagcagatggcgaacttattgttgtaaaagatacagcattcgaaaatgtaaccaacgcagattactccttagagtaccgtattcgcccgcgcaacaacggcaacacaggcaacaagtacctgcacgctatgtcgcgctacgaaggccctaaagaatattactttggcggtttaagcatgcaaggctctactgcaagtacgcaagtagaagcaggtttcgtattgccagaaaacaccactagcattagcaaccgcttggtgcaggccaagtacccgttagagctaggtacaacaggcatgagcgacggctactggtacgaagtacgcttcgatatgataggcaatacaggcaccatttacctagatggcgaaccacaaggcagctttaccgatgccgatggcctttacccattaacaggtaaaattggctttatgacttacaaccgctcattcgaaattgattgggtgcgagtaggcgacccagctattaagcctgtacaactttcactggattacgccagcccgctatgggaagcagcggcagaccaagacccgctaaacgtaacagttactgccatacaaagcgatggcgtaacagcagatacctttaccgcagttagcagcgataccaatgtagtaaccacaagtattgcaaataacgtagtaaccattacccctgtagctcaaggtagtgccaccgtgacctttaccgctggttcagatgctaatcgcgttaaaacaattgatgtagaaattgcacgcgcgtttgttatgtctactaccgactacggcgatatagcttctaaggtaacaccaactgttggtatgactgacgccaacccagacgcacatttaagcattacattcgatagcgcacctaccctaagcggtgttggctctatacgtatatacaatgcagcagacgatagcgaagtagatgttattcgccttaccgacgaaagtgatgcattgggttacgccggccaagccaacaagcgtgaattaaataccacaccggtttacttggatggcaacaccctacacgttagcccacacagtaacgcacttgcctacggccaagactactacgttgccattggcgataacgtacttaccggcgcaacactaaacaccattgcgtttgatggtttaggtaaaaacgcgggttggactttctctaccaaagcctctgcccctaccggcaacaccgtaactgtagacgacgatgcaagtgcagatttcagcacagtacaaggtgcgttgaactatgctatggcaaataccacggacgattcaatcaccattaacattgctaacggcaactactacgagccgctatatctagcagagcgcaacaacgtaacgctaaaaggtgaaagccgcgacggcgttgttattcattacaacaaccacgaagccatgaacggtggcagcactggccgcgcaaacttctatgttgccaactcagacatgctaaccctagaaacgctaacccttaaaaacggtcatcagcgcactggtggtggcgaccaagcagaaactatctacttcaatagcagcagcaataccgatcgcttaattgccaaaggcgctgcttttattagtgaacaagatacgctgttacttaaaggctacaactggttctacaactcgcttgtggtaggtaacgtagactttatttggggctacagcgcagtaaccttgtttgaagaaacagaaattcgatctattgccgactctaaaccaggtgcgggcgactcgggtggctatattctgcaagcgcgtacgccactagaaacagaccttggctttgttttcttaaatagcgaattaacaaaagctaccggcgtaaacggtaacgaaattggcgatggcaaaacctaccttgcgcgcagcggcggcagcacgggttacttcgataatatttcgtttattaacaccaaaatgggtagccatattgccgacataggcttcgcctacgccgacattaacggtcaacctgcccctaacccagcggtagctactgctgacgcaggctggcgtgaatttggcagcatggattctgcaggcacggctctagatgtatctgcacgctgcggtgatagcggcagctgtatccaacttacgcaagcacaagtagatgcgcagtactgtaaccgcgcgcaaatttttgctagctggaacgattggacaggctgggacccgttgccagaagatacctctgacgatgcctgtgctgaccccgttatacctggtgcagtaacgtggactggcattgcaatgagccttgggggttctacaacatctgtttccggcaacattaccgagcaaacagacagcaatattacattcactgcagacggcggtaagtttgaatcgagcaaactttcaacttacttcgcttatcaagaattgactggcgactttgtaattagcgccaaagctaaaaccattggcttactgcgcgaaaacggcagctaccagttccctacaggcatattgatgtgtgtttgcgatgcggcagcggcaacaactggcttaatgggccacgccagcctcaatgacattacagttgatactactgtgaatttagttgccacctacggccacattcaaaccacagctggtagctggaataaaactggaacgactgacgtaaccgctggcgacaacctgtatatacagctagagcgcgcaggtaatagttataccgcacgctactcgactgatggcggtgccacctatagcaacattggtggcagctcatttacagacacccttccagacacacttaaagtgggtttcttcgctacgcctaacaacaccggtgagcaaactttcgtttacgaagatatacaaatcactcagtaa

SEQ ID NO: 117 - protein, 391 aa, Microbulbifer degradans
MGMGTKINFLLLGFILSACSLSGCADKIKRNTPLTETALPSKKILYVQTEVCDPPSQLTGSCYNSLQRAIDVAHTVPSATHVTIEMAAGHYHERIVLSRGNIDIVGAGKNKTYVQYNLNAEQGKAYHRDGWGTPGSATFTINASEVNVSDLTIENTFDFLRNDSKDKTDPSKVRASQGVALLLDEHSDKVALYRVGLYGYQDTLFANGKRAFIYQSDIAGNVDFIFGAGQVVIENSRVISRPRGKAIASNEIAGYITAPSTNITDAFGLVFINSRLEREQGVADASVTLGRPWHPTTNFSDGRYADPNAIGHALFFNCFMDAHIHPARWSSMKGTAKDGSKTLVFTPEQSRFFEVQSFGPSGNDEVTTSYHSLSADSLREQALGDWNVSIN

SEQ ID NO: 118 - DNA, 1176 bp, Microbulbifer degradans
gtgggtatgggtacaaaaattaattttttgctattaggttttattttgtctgcatgttcattaagtggctgcgccgacaaaataaagcgcaatacgcctttaaccgaaacggcattgccgagtaaaaaaatactctatgtacaaaccgaagtatgtgacccgccttcgcaattaacgggtagttgctacaacagcttgcagcgagctattgacgtggcgcacacagtgccgtctgctacccatgtaaccattgaaatggctgcggggcattaccacgaacgcattgtgcttagccgtggcaatatcgatattgttggtgcaggtaaaaataaaacctatgttcaatacaacctgaatgccgagcagggtaaagcttatcaccgcgacggttggggtactcctggctcagctacatttaccattaatgccagtgaagtaaatgttagcgatttaactatcgaaaatactttcgactttttaagaaatgattcaaaagataaaaccgacccttcaaaagtgagggcatcgcaaggcgttgcattattattggatgaacacagcgataaggttgcgctgtatcgagtaggcctatacggataccaagacaccctatttgcaaatggaaagcgtgcatttatctaccaatcagatattgcaggcaatgttgattttatttttggcgctggccaagtggttatagaaaatagtcgtgttatttctaggccgcgcggcaaagccattgcttccaatgaaattgccggctatatcacagcgccatccaccaatattacggacgcctttggtctggtttttattaatagtcgattagaacgtgagcaaggcgtggcagatgcgtcggtcaccttgggtcgcccttggcaccctacaaccaatttcagcgatggccgatatgccgacccaaacgcgattggccatgcgctattttttaactgctttatggatgcgcatattcaccccgcgagatggtctagcatgaaaggcaccgctaaagacggcagtaaaacgctagtgtttacgcccgagcaatcgcgtttttttgaagttcagtcctttggccccagcggcaacgatgaagtaaccacctcgtatcattcgttaagcgccgactcattacgcgaacaagcgctcggcgattggaatgtatcaattaactaa

SEQ ID NO: 119 - protein, 914 aa, Microbulbifer degradans
MSALTRPKFGAHTKLFHAIKHALTPVIFLGAAAFPLAAHSQYNMENLDRGLVAIDRKDGSVLVSWRWLGQEPDNTSFNVYRNGTLLTSSPLTNKTNFVDTSGNPNANYAVEAIVNGASQSLATTHVWSDIYRTIPLQRPPGGTTPDGVAYTYSPNDISAADLDGDGGYELIVKWDPSNAKDNSQSGYTGNVYLDAYEISGEFMWRIDLGRNIRAGAHYTQFLAFDFDSDGKAEVAVKTADATKDSQGVVIGDSNADYRNSAGYVLSGPEYLTMFEGQTGRALNTVNYVPARGSVSSWGDNYGNRVDRFLGGVAYLDGQNPSLIMSRGYYTRTVVAAWDWRNGQLSQRWVFDSNTSGNSSYAGQGAHSLTIGDVDADGKQEIVFGAMTIDDNGTGLNNTRLGHGDALHLSDMDPSNPGLEVFMVHECPSCYGEHGIEMHDAATGQILWSHPGDYIDIGRGVAMDIDPRYAGYEAWASRGGLYSAKGETISSTRPSQINFAAWWDGDLLREILDNNYINKWNYTASSTTRLLSAGNYGAASNNGTKATPGLSADILGDWREEVVWRNSNNQELMVFTTPHESEYRLRTLMHDPQYRTAIAWQNVGYNQPPHPSYFLGAGMTTPNQPHITIVGEGTVQPPAPTGDAIQENATGFCGYEGTIDSNHSGYTGAGFTNTTNATGAGINWNLHASTAGTYRLSMRYANGSTARGAVLNVETTGNSYPMAFAPTSTWTNWQEEYVDAHLNAGYNSIRLEANQAAGLPNLDAIYLADGLTAAACGQTSSSSSSSSSSSSSSSSSSSSSSSSSSSSSSSSSGGTTAGLACANGSTDTWGTGFVLNGFQVENEGQQATNNWQVTLQFDQPVNITNAWGVNVETTGTTVVATSVGYNSHLNPGQSASFGMQGTSATAVSNPLCSAQ

SEQ ID NO: 120 - protein, 82 aa, Microbulbifer degradans
MACWPSFSTWKPFNTNPVPHVSVLPLAQARPAVVPPDELLLELLLELLLELEELLEELEELLEDELLLDVWPHAAAVRPSAR

SEQ ID NO: 121 - DNA, 2745 bp, Microbulbifer degradans
atgtcggcactcactcgtcccaaatttggtgcacacaccaaactgttccacgctataaagcatgcgttaacccccgttatatttttaggtgctgctgctttcccacttgccgctcacagccaatacaacatggaaaacctcgaccgcgggttggtggccatagatcgcaaagacggcagcgtattagtaagctggcgctggttggggcaagagccagataacaccagcttcaacgtatatagaaacggcacactattaaccagctccccccttaccaataaaacaaactttgtagataccagcggcaacccaaacgctaattacgcggtagaagccatagtaaacggcgcgagccaatcactagccaccacacatgtatggagcgatatataccgcactattccgctgcaaagaccaccaggtggcaccacccccgacggagtggcatacacctatagccccaacgatataagcgcagccgatttagacggcgatggcggttacgagctaatcgtaaaatgggacccctccaacgcaaaagacaactcgcaaagtggctacaccggcaatgtgtatctcgacgcttacgaaatatctggcgagtttatgtggcgcatagacctaggccgcaatattcgagcaggcgcccactacacgcaatttttagcattcgattttgatagcgatggcaaagcagaagttgcagttaaaaccgcagacgccaccaaagacagccaaggagtagtaataggagacagcaatgccgattaccgcaacagtgcaggctatgttttatctggccccgaatacctcaccatgtttgaaggccaaaccggtagagcgctaaataccgttaactacgtacccgcgcgcggcagtgtttctagctggggcgacaactacggcaaccgtgttgatagatttttaggtggcgtagcctacttagatggccaaaacccaagtttgattatgtcgcgcgggtactacacccgcaccgtggtagcagcatgggactggcgcaatgggcagcttagccaacgctgggtatttgattccaacaccagtggcaacagcagctatgcaggccaaggcgcgcacagccttaccattggcgatgtagatgcagacggaaaacaagaaattgtatttggcgccatgaccatagatgacaacggcaccggcttgaacaatacccgcctaggtcacggcgatgcactgcacctatccgacatggacccaagcaacccaggcttagaagtgtttatggtgcacgaatgcccctcttgctatggcgagcacggaatagaaatgcacgatgccgccaccggccaaatactatggagccacccaggcgactacatagacataggccgaggtgtagccatggatatagacccacgttatgccggctacgaagcttgggcttcgcgcggtggtttatacagtgcaaaaggcgaaacaatatcgagcacgcgcccgtcgcaaataaactttgccgcttggtgggatggcgacttactgcgcgaaatactcgataacaattacataaacaaatggaactacaccgccagctctaccacgcgcttgctaagcgcaggtaactacggtgcagcatcgaacaacggcaccaaggctacaccagggctttcggccgatattcttggtgactggcgcgaagaagtggtatggcgcaacagcaacaaccaagaacttatggtgtttaccaccccacacgaaagtgaataccgcttaagaaccctaatgcacgacccgcaataccgcacagccatagcttggcaaaacgtgggctacaaccaaccacctcacccctcttactttttgggtgcgggtatgactacccccaaccaaccacacataaccatagttggcgaaggcacagtgcagcctccagcccctacaggcgacgcaatacaagaaaacgccaccggcttttgcggctacgaaggcactatagatagcaaccactctggctatacaggcgcgggctttactaacactaccaacgcaacaggtgcaggcattaactggaacctacatgcgtccaccgccggtacataccgcctaagcatgcgttacgcgaatggcagtacggcacgaggtgctgtgctaaacgtagaaacaaccggtaatagctaccccatggcatttgcaccaacaagcacatggacaaactggcaagaagaatatgtagacgcccacctaaacgccggctacaacagcattcggcttgaagcaaaccaagcggcaggtttgcccaacctcgatgccatctacctagccgatggtcttacggcggcagcgtgcggccaaacatctagcagcagctcgtcctccagtagctcctctagttcttccagcagctcttcaagctctagtagcagttccagtagtagctcgagcagcagctcatccggcggtacaacagcaggcctagcttgcgccaacggcagtacagatacatggggaacggggtttgtgttaaacggcttccaagtagaaaacgaaggccagcaagccaccaataactggcaagtgacacttcaattcgaccagcccgtaaacataaccaacgcatggggtgtaaacgtagaaacaacaggcacaaccgttgtagcaacaagcgtaggctacaacagccacctaaacccggggcaaagtgctagctttggaatgcaaggaacatcggcaacggcggtaagcaacccgctatgcagtgcccagtaa

SEQ ID NO: 122 - protein, 789 aa, Microbulbifer degradans
MRSLAPIKIREKIRETLMFNIRAWQLDLPLALLAFSSTSYAIDNGTYTIQSKHSGKVVEVAAGSVDDAANVAQWPSNGHPTQQWIITQISGDDYSVINVNSGKAMEVYDFGTTDGGNIVQYPYWGGAPQLWTITDQGGYYSLINKHSGKALDLLNWDTTDGANIGQWAWWGGDAQLWALNTVQPSTVTFTLEENQAGFCSVDGSIDSNHTGYTGSGFANTTNANGQGVNWSVNVATAGTYTFTWRYAGTSNRPANLLIDGSTQVSGIALNSTGAWATWANSAEISVWLDTGVHSLRLQATTSAGLPNIDSLSITGQSAAAGNCSGAIEPITFATPSFTNIAVHDPSVIEANHQYYVFGSHLSVAKTPDLKNWSRVADGVTTNNPLFNDVTSELAEALAWAETTTLWAPDVTYVNGRYLMYYNACRGDSPLSAMGIASSNNIEGPYTNDGIFLKSGMWGQTSEDGTVYDATVHPNAVDPVIFSDANNRMWMTYGSYSGGIFIMELNPSTGFPYAGQGYGKHLMGGNHARIEGAYTIYSPETGYYYMYVSYGGLGADGGYNVRVARATSPDGPYYDANGTNMANVKSNPSLPLFDDASIAPHGVKLMGNHVFSGTNNVLGYVSPGHNSAYRDATTGQTFLLFHTRFPGRGEEHEVRVHEVFYNDAGWPVIAPLRYAQKVDANNPNRSASELNAVYASELPGSYQLINHGKDISATIKNSVNITLNSNGSISGELSGSWTYNANTRNTVITVAGVAYRGVVSRQWNQARNRFEVTFSALSADGTAIWGVNSD

SEQ ID NO: 123 - DNA, 2370 bp, Microbulbifer degradans
gtgcgcagtctagcccccataaaaataagagagaaaataagagagacactcatgtttaatatacgcgcttggcaacttgacttgcccttggcgttattggcgttttcgtctacaagttacgctatcgataacggcacttacacaattcaatctaaacacagtggcaaggttgtagaagtggccgcaggcagtgtagatgatgctgcaaatgtggcccaatggcccagtaatggccatcctacccagcagtggataattacccaaattagcggcgatgattactcggtaataaatgtaaatagcggcaaagctatggaggtatacgacttcggcaccacggacggcggcaacatagtgcaatacccctactggggaggcgccccccagttgtggacaattacagatcaaggcggttattacagcttaataaacaaacacagtggtaaagctttagatttgttaaattgggataccacagacggcgccaatataggccagtgggcttggtggggcggcgatgcgcaactgtgggcactgaacacagtgcaacccagcacagtcaccttcacacttgaagaaaaccaagcgggtttttgcagcgtagatggcagcatagatagcaatcatacgggctataccggcagcgggtttgccaatacaaccaatgcaaatggccaaggagttaattggtcggtaaatgtagccacagctggtacctatacgtttacatggcgctatgcgggcactagcaaccgcccagccaacttgctaatagatggcagcacacaggtttcgggcattgctttaaattcaaccggcgcatgggcaacttgggctaatagtgcagaaataagtgtttggcttgacacaggtgtgcactcacttcggctgcaagccacaaccagcgcgggcttacctaatatagattcgcttagcataaccggccaaagcgcagcagcgggcaactgcagcggcgcaattgaacctatcacttttgccacaccaagctttaccaatatagcggtgcacgacccctcggtaatagaagcaaaccatcaatactacgtatttggctcccacctttctgtggctaaaacgcccgacctaaaaaactggtcgcgcgtggcggatggtgtaaccaccaataacccattgtttaacgatgtaaccagcgaacttgcagaagcattagcttgggcagaaaccactaccctgtgggcgccagatgttacctatgtaaatggtcggtatttgatgtattacaacgcctgccgtggcgactcaccactgtcggctatgggtattgcttcttcgaacaacatagaaggcccttacactaacgatggtatattccttaaatctggaatgtggggccaaaccagcgaagatggcactgtgtacgacgcaaccgtgcaccccaatgctgtggaccccgttatttttagcgacgcaaataatcgcatgtggatgacctacggttcgtattcgggtggtatttttattatggagttaaacccatccacggggttcccttacgcggggcaaggttatggtaaacatttaatgggtggcaaccacgcgcgcattgaaggcgcttacaccatctacagcccagaaacgggctactactatatgtatgtaagctacggtggcctaggcgcagatggcggctataacgttcgtgtggcccgagcaactagcccagacggcccctactatgatgccaacggcaccaatatggccaacgtaaaaagcaacccaagcttgccactgttcgacgacgccagcatagcaccccacggtgtaaaacttatgggtaaccacgtgtttagcggcactaacaatgtacttggttacgtatcaccagggcacaactctgcataccgtgacgccactaccggccaaacatttttactattccacacacgcttccctgggcgcggcgaagagcatgaagtgcgagtgcatgaagtgttctacaacgatgcaggctggccggtaatagcaccattgcgctatgcccaaaaagtagatgccaacaacccaaatagaagtgcgagcgagctaaatgcagtgtacgcaagcgaactgccaggtagctatcagctaattaaccacggcaaagacataagcgcgacaattaaaaattccgttaacatcacgctaaacagcaacggcagtatctctggcgagctatctggcagctggacatacaacgccaacacccgcaataccgtaatcaccgttgccggtgtggcctaccgcggcgtggtatctcgccaatggaaccaagcacgcaaccgcttcgaagtcaccttcagcgccctatctgcagacggcacagcaatatggggggtgaacagcgactaa

SEQ ID NO: 124 - protein, 362 aa, Microbulbifer degradans
MSSFIMDKSQLQSGFAFKTSGFNVLIVVTFLALLAALVGCSSAKLAPVASPSLPQPLVAQRADPWVHKHSDGYYYFIATVPAYDRLEMRRATTIAGLRSAPAVVVWQRNTIGGMSANIWAPELHFIDGKWYIYVAAATDHNKPWTIRMHTLSNASANPMQGEWQEEGRFHTPLDTFSLDATTFEHRGKRYLVWAQQNEARTYNSALLIAQMDSPTSITGPIVTLSEPTLPWEIIGHKVNEGAAVIKHGKRIFISYSASATDHNYAMGLLWADENADLLDAASWTKSPEPVFYSNEQLKRFGPGHNCFVKAEDGVTDLMVYHARDYKEIDGEPLRDPNRHTRVRKVYWDEQGMPDFRQHEADL

SEQ ID NO: 125 - DNA, 1089 bp, Microbulbifer degradans
atgagtagcttcataatggataaaagccagctacaaagtggttttgcgtttaaaacaagtggttttaacgtgctgattgttgtcacatttttggcattgcttgcagcgcttgttggctgcagcagcgccaagctcgcacccgtcgcctctcctagtttaccgcagccattagtggcccaacgggcagacccttgggtgcacaagcacagcgatggttattactactttatagcaacggtaccagcatacgaccgcttagaaatgcgtagggccacaaccatagcaggcttacgtagcgcgcccgctgtagtggtatggcagcgcaatactattggaggtatgagcgcgaatatttgggcgcccgagctgcattttattgatggtaaatggtacatctatgtagcggctgccaccgatcacaacaagccgtggacaattcgtatgcacacgctttccaatgcatcggccaaccctatgcaaggtgagtggcaagaagaggggcgctttcatacaccgctagatactttctcgctagatgccacaacctttgagcacaggggtaaacgctatttagtatgggcgcaacagaatgaagcccgtacttataactcggcgttacttatagcgcaaatggatagccctacaagtattactggccccattgttaccttaagtgaaccgacattaccgtgggaaattattggccataaggttaatgagggtgcggcagtaattaaacacggtaagcgtatttttataagttattccgccagtgcgaccgatcataactatgcgatgggtttgttatgggcagacgaaaacgctgatttgctcgacgcagcaagctggaccaagtcacccgagcctgtattttactcaaacgaacaattaaagcgctttggccctggccataattgttttgttaaagctgaagatggtgttaccgatttaatggtgtaccacgcgcgtgattataaagagatagatggtgagccattgcgagacccaaaccgccacacgcgggtgcgcaaagtgtattgggatgaacagggcatgccggattttcgtcaacatgaagcagacctatag

SEQ ID NO: 126 - protein, 314 aa, Microbulbifer degradans
MKKLSPLIEQRADPYIYKHTDGYYYFTASVPAYDGIELRRAKTIQALATAETVMVWRKPSEGDYSELIWAPEIHFNMGAWYVYFAAAPSREIKFDLFQHRMYAISCSDANPLTGEWIFEGKIDSGIDAFCLDATTFTHSNELYYVWAQKELDVRGNSNLMIAKMETPTKLATKPVRLSKPEYDWEIQGFWVNEGPSIVKHGSRIFISYSGSATDERYAMGILWAEQSADLLDPASWTKSVEPVLVSEPSEKVFGPGHNSFTVDEEGNDMLVYHARNYTEIEGDPLWDPNRHTYVKKLRWDETGMPIFGSPAFEE

SEQ ID NO: 127 - DNA, 945 bp, Microbulbifer degradans
gtgaaaaaattatcgcctcttatagagcaacgtgcagacccttatatttataaacacaccgacggctactattattttacggcttcggtgcccgcctatgatggcatagaactgcgtcgcgcaaaaactatacaagcgttagccaccgcagaaaccgttatggtgtggcgcaagccaagcgaaggtgattatagtgagcttatttgggcgccagaaatacactttaatatgggggcttggtatgtatattttgctgcggctccatcacgtgaaattaagttcgatttatttcaacaccgcatgtatgccattagctgtagcgatgccaacccgctaacaggtgaatggatatttgaaggtaaaatagatagcggcatagatgcattctgtttagatgccaccacctttactcacagcaatgagctctactatgtttgggcgcaaaaagaattagatgttcgcggcaactctaatttgatgatcgcaaaaatggaaacgcccaccaagcttgccaccaagcccgtgcgtttatctaaacccgaatacgactgggagattcagggtttttgggttaacgaaggcccatccattgttaagcacggctcacgtatttttatttcttattctggctctgctaccgatgagcgctacgcaatgggtattttgtgggcagaacaaagcgcagacttactagacccagcaagttggaccaagtcggtagagcctgtattagtttctgaaccctctgaaaaagtatttggcccaggccacaatagttttactgtggatgaagagggtaacgatatgttggtgtatcatgctcgcaattataccgaaattgaaggcgacccgctgtgggacccaaatcgtcatacttacgttaaaaaattgcgctgggatgaaacaggcatgcctatttttggcagccctgcgtttgaagagtag

SEQ ID NO: 128 - protein, 350 aa, Microbulbifer degradans
NGYYAVLNKHSGKALDLYGFDTSNGANIAQWAFWGGDPQQWQFTKIANVGAPPVDTSTTNGATNHWSLTGNLVTHDPTMAYENGSWWLYQTGEGIYGKYSANGLAWDGLPSVFPNGLSWWKTYVPGQSNNDVWAPDVRTYNGRVYLYYSISTFGSRVSAIGLASASSLAASDWQDHGLVINTTSSSDWNAIDPDLVVDEHGNPWLTMGSWNSGIKVMRLNPITMKPIGTLYSIAQKGGGIEAPSIVYRRGYYYLFVSIGKCCAGVDSTYQIAYGRSTSITGPYLDKNGNDMMSGGGSILDAGNNVWVGPGGQDIINTDVIVRHAYDATDAGTPKMIISTLNWDANGWPKY

SEQ ID NO: 129 - DNA, 1053 bp, Microbulbifer degradans
aatggctattatgccgtgctaaataaacacagcggcaaagcgttagatttgtatggttttgatacgtctaacggcgcgaatattgcgcaatgggccttttggggcggggacccgcagcagtggcaatttaccaaaatcgccaatgtaggtgcgccgccagtagatacatctaccaccaacggtgcaaccaaccactggtccttaaccggtaatctagtgactcacgaccccacaatggcctacgaaaacggctcatggtggttgtatcaaaccggcgagggaatttacggtaagtattcagccaatggtttggcgtgggatggcttaccttctgtgtttcccaatggtttaagttggtggaagacctatgtacccggccagtcgaacaacgatgtatgggcgcctgatgtacgcacttataatgggcgggtttatttgtactattccatctctacttttggctcgcgtgtatctgccattggtttggcgtcggcatcgagtttggctgcgagtgattggcaggaccacggcttagtaattaataccacctcatctagcgattggaatgcgatcgacccagatttagtggtcgatgagcatggcaacccttggttaacaatgggaagttggaacagcggtattaaagtgatgcgcttgaaccccattaccatgaagccaattggcacactttattctattgcgcaaaagggcggcggtattgaagcgccttctattgtgtatcgccgtgggtattactatttatttgtttctatcggcaaatgctgtgcgggcgtagatagcacctatcaaattgcttacgggcgctctacaagtattaccggcccttatttggataagaacggcaacgatatgatgagtggtggtggcagtattttagatgcgggcaacaacgtgtgggttggccctggtgggcaagatattattaacaccgatgtcattgtgcgccacgcgtacgatgccacagatgcaggcacacctaagatgattattagtaccttgaattgggatgctaatggatggccgaaatactag

SEQ ID NO: 130 - protein, 346 aa, Microbulbifer degradans
MLNKNKRPITFALVVSLLALLALAGCSEAKQVSIHDPVMIKEGDTYYLFSTGPGITMYSSSDMKNWRREGEVFNQAPSWASNAVPYFKGHLWAPDIIEKDGLFYLYYSVSAFGKNTSGIGVTVSPTLNPRAPNYGWQDKGMVLRSVPERDEWNAIDPNIVVDNNGTAWMAFGSFWQSLKMVALDSSWTKIAEPQQWHTIAALPKGSMPTGDAVKDGEIEAPFIFKKNDDYFLFVSWGKCCRKDESTYRLAMGRSKNTTGPFLDKNGKDLAQGGGTLLISGNKNWPGLGHNSAYTFDGKDWLVLHAYESADNGLQKLKILEINWDKDGWPTVDTKELDEFVSIELTQ

SEQ ID NO: 131 - DNA, 1041 bp, Microbulbifer degradans
atgcttaacaaaaacaaacgcccaattacattcgctttagtcgttagcctcttagccctgcttgcccttgcaggctgcagcgaggcaaaacaagtaagcatccacgacccagtaatgattaaagaaggtgacacctactacttgtttagcactggccccggcataacaatgtatagctctagcgatatgaaaaactggcgccgcgaaggcgaagtatttaatcaagcccctagttgggcctccaacgccgtaccctattttaaaggccacctgtgggcacccgacatcattgaaaaagatggtctgttttacctctactattctgtgtctgcttttggaaagaacacatccggcattggcgttaccgtatcgcccacgcttaacccacgcgcgcccaattacggttggcaagataaaggcatggtattgcgcagcgtgcctgagcgcgacgagtggaacgctatcgaccccaatattgtggtagataacaacggcaccgcatggatggcttttggctccttttggcaaagcttaaaaatggtggcactagacagcagctggacaaaaatagctgagcctcaacagtggcataccatagcagccttacccaaaggcagtatgcccacaggcgacgcagtaaaggacggcgaaatagaagctccttttatttttaaaaagaacgacgattactttttgtttgtaagttggggtaaatgctgccgcaaagatgaaagcacctaccgcctagcaatgggccgcagcaaaaatactaccggtccattcttagataaaaacggcaaagacctcgcccaaggtggtggcaccctattaataagtggcaacaaaaactggcccggcttaggccacaacagcgcctacaccttcgacggcaaagattggcttgtgctacacgcctatgaatctgcagataacggtttacaaaaactaaaaatattagaaataaactgggataaagacggctggccaactgtagataccaaagaactggatgagtttgttagtattgaattaactcaataa

SEQ ID NO: 132 - protein, 665 aa, Microbulbifer degradans
MDNIMKMIIKLALAVTLAVWVAGCTNQAGLNAENKNIERQTINSPDKSLKVRLSLDESGKVFYSISRNGEQVMLPSQLGVELNSQAFTDGLTITDVDAGKVNDSYTLLHGKQRDITYNANEKIYSLKNKQGDKLIIAFRVSNDGVAFQYRFPNTAKQLLAVKKEITSFAFEHTTKAWLQPIAVAQTGWANTNPSYEEHYQMNIPVDTVSPSPAGWVFPALFKANKHWLLITEAGMNGDYHASRLHAESPNGEYSLGIPMAAEVFEQDGNKGALLAQSNTAFHSPWRVILVGGLDTIIASTLGTDLADPAIAKMDFVKPGTASWSWALLKDESVNYETSLEFIDYAAEMGWDYTLVDADWDRRIGYERTAQLAAYAQSKNVGLLVWYNSSGDWNTTEYSPKSALLDRDKRRAEFARLQNMGVKGVKIDFFPGDGKSVMAYYNDLAKDAADYNLLVNYHGSSLPRGLHRTYPNIMTMESVHGFEMITFMQPSADKAATHMAILPFTRNAFDPMDFTPTTFSDIPNIERRTSNGFELALPVLFLSGLQHIAETAQGMATNAPDYVKAYMRDIPVLWDESKLIDGMPGEHVVIARKHGERWFVAGINATNEAINLEMNFDFALGKQGTLITDSNINTKGVESFTSHTITATKNNALTVKANGGFVIVFN

SEQ ID NO: 133 - protein, 619 aa, Microbulbifer degradans
MAAGQIISLEVKVKKIEEIMKHTARTIALGATGAALLTGLIACNGTNVNTNGDTQQASIKKAPEGMFANPLFANGADPWLEYYDGNYYLTTTTWTSQLVMRKSPTLDGLSTALPVNVWSDSDLTRCCNFWAFEFHRLNGPNGWRWYLMYTSGQHGTLDHQHLSVLESVGDDPMGPYTYKGEMMPNTWNIDGSYLEHNGQLYLLWSEWVGDEQQNFISKMTTPWSIEGPRALLTRPEAEWEKSGRKVNEGPEILKKDGRTFLIYSASYCDTPDYKLAMKELTGDDPMNSEHWTKYDKPVFERGNGVFAPGHNGFFKSPDGTEDWIVYHGNSKEEHGCGATRSVRAQKFTWNTDGTPNFGEPIPEGQFLPLPSGENGPLVTALQGARIQLRNGESCLLAEGKELKQGSCQAEASLWVMDNTADNHYRFGNVASNLFLTADEGLSQSAWVNTASQRWALNAGEGNFVAFTNKYTGDALMQNNWQILPVGKVAISSIQSGRVLQACDKNSANVNQGGWQGRACQAWQFNPASEGHVQIKTGNQCLTVENKSIVPGTNVIAGECESTSSQWLYQLDKEGRATFTNRESKQRLDLANCGLADGTNFAQAPALDTICQAFQVRYLP

SEQ ID NO: 134 - DNA, 1860 bp, Microbulbifer degradans
gtggccgcaggccaaataatttcactggaggttaaagtgaaaaagatagaagaaataatgaaacacacagcgcgcactatagcgctaggtgcaacaggtgccgccttgctaacggggttaattgcctgtaacggtaccaatgtgaatacaaacggggatacccaacaagcaagcattaaaaaagcgccagaaggcatgtttgccaacccgttgttcgccaatggcgcagacccttggttagagtattacgatggcaattactacctcactaccaccacatggacatcgcaacttgttatgcgtaaatcacccacgttggatggtttgtctactgcgctgccggtgaatgtatggtccgattcagatttaacccgctgctgtaacttttgggcgtttgaattccatcgcttaaacggccctaacggctggcgttggtatttaatgtacacctcgggccagcacggcactttagatcaccaacacttaagcgtattagaaagtgtgggtgacgaccctatggggccatacacctacaaaggtgaaatgatgcccaatacatggaatatagacggcagttatttagagcataatggccaattatatttgttgtggtctgaatgggtaggtgacgagcagcaaaactttatatctaaaatgaccaccccatggagcattgaaggcccgcgagcactgttaactcggccggaagcagagtgggaaaaaagcggtcgcaaagttaacgaaggcccagagattctaaaaaaagatggtcgtacctttttgatttactcggcgagctattgcgatacgccagattataaactggcaatgaaagagctaacgggcgacgacccaatgaactccgagcactggactaaatacgataagcccgtgtttgaaagagggaacggtgtgtttgccccaggccacaatggtttcttcaaatcgcccgatggcacagaagattggattgtgtaccacggaaattcgaaagaagagcacggctgcggtgcaacgcgctctgtgcgcgcacagaaatttacttggaacacagacggcaccccaaattttggtgagccaataccagaaggccaatttttgcccttaccttctggcgaaaacggtcctttagtgactgcactgcaaggtgcacgtattcagttgcgcaatggcgaaagctgtttattagccgaaggtaaagagctgaagcagggcagttgccaagcagaagccagtttatgggtaatggataacacggcagataatcactaccgctttggcaatgtagccagcaatttatttttaacggcagacgaaggccttagtcagagtgcctgggttaatactgcaagccagcgctgggcacttaatgcaggcgaaggtaactttgttgcgtttacaaacaagtacaccggcgatgcgcttatgcaaaataattggcaaatactaccggttggcaaagtggcaattagcagcattcaaagtggccgcgtattacaggcgtgcgataaaaacagcgcgaatgtaaaccaaggcggctggcagggtagggcttgtcaagcatggcaatttaacccagcaagtgaaggccatgtgcaaattaaaacgggcaaccaatgtttaaccgttgagaataaatccatagtgcctggcaccaatgttattgccggcgagtgtgaatcaactagcagccaatggctttatcaattagataaagaaggccgcgcaaccttcacaaaccgcgaaagcaaacagcgtttagatttagcaaactgcggcctagccgacggcaccaacttcgcacaagcccctgcgttagatactatttgccaagcattccaagtgcgttatttaccgtaa

SEQ ID NO: 135 - protein, 534 aa, Microbulbifer degradans
MNPASTLSVKTTNKTTNHLKKVALTVAAIVAPLTSWADVKVSLNPQNTGETISKYIYGQFAEHLGSGIYGGIWVGEDSPIPNKNGFRNDVIKALQELQVPVIRWPGGCFADEYRWRDGIGPREQRPIRVNTHWGGVEEPNTFGTHEFFELVELLNTEAYVAGNLGTGSPQEMAEWLEYIVSNSNSTVVAERKKNGREEPWEVAFWGVGNESWGCGGNLTPEYYTNLYRHFSTFVKATGAKRPKLVASGSYDDDETWTTPLSKLKNNIDGISHHYYTLPTSDWSIKGAATGFDEKEWILTLERTLKIDSYLATQTGILKKNNPEGNIGLYLDEWGTWYDAEPGTNPGFLYQQNTVRDAIVAAVNLNIFHNYADRLHMANIAQMVNVLQAMILTDNEKMLLTPTYHVFKMYIPFQDATHIPLDIKGQRDYSAHKTTVPGFSASAAKTPNGNIVVSLVNLNPNEAEEVSIALQGIKVKTITGELLTSQKMDAHNTFDKPNNVQPRALNQSDYSISKNGKTLTVKLPAKAVVVLQLNK

SEQ ID NO: 136 - DNA, 1605 bp, Microbulbifer degradans
atgaacccagcttcaaccctaagtgtgaaaacaactaataaaacaacaaaccacctcaaaaaagttgcccttaccgtagccgctatagttgccccgctaacaagctgggccgatgtgaaagttagcctaaacccacaaaacacaggcgaaaccataagtaaatatatctacggccaattcgcagagcaccttggcagcggcatatacggcggcatatgggtgggcgaagactccccaatacccaacaaaaacggctttcgtaacgatgtaatcaaagccctgcaagagctacaagtacctgttataagatggcccggtggctgctttgccgacgaatatcgctggcgtgatggcattggcccacgtgagcaacgccctatccgcgtaaatacccactggggcggtgtggaagaacccaatacctttggtactcacgaattcttcgaattagttgagctacttaataccgaagcctatgtggcaggtaacctaggcactggctcaccacaagaaatggccgaatggctggaatatattgtttccaactccaactctactgtagtggcagagcgcaaaaaaaatggccgcgaagagccttgggaagtggccttttggggtgtgggtaatgaatcttggggttgcggtggcaacttaacgcccgagtactacaccaatttatatcgtcatttttccacttttgttaaagccactggcgctaagcgcccgaagttagttgcaagcggctcgtatgatgatgacgaaacttggacaacgccactaagtaagctcaaaaataatatagatggtataagccaccactactacaccttacccaccagcgactggagcataaaaggtgcggctacaggctttgatgaaaaagaatggattcttacccttgagcgcacattgaaaatagacagctaccttgcaactcaaacgggtattcttaaaaagaataaccccgaaggcaatatagggttgtatttagatgaatggggtacgtggtacgatgcagagcccggtacaaaccccggctttttataccaacaaaataccgtgcgcgacgccatagtagcagcagtaaacttaaatatattccacaactatgccgaccgcttacacatggcgaacatcgcccaaatggtaaacgtactacaggcaatgatactgaccgacaacgaaaaaatgttgctcacacccacgtatcacgtttttaagatgtacataccatttcaagatgctacccatataccgttagatataaaaggccagcgcgactacagcgcacataaaactaccgtaccagggttctcggcctcggcagctaaaaccccaaatggcaatattgtagtttcacttgttaaccttaacccaaacgaagcggaagaagtgagcattgcactacaaggcatcaaggtaaaaaccattactggtgaattacttaccagccaaaaaatggatgcgcataacaccttcgacaagccaaacaatgtgcagccacgcgcacttaaccaaagcgactacagcattagcaaaaacggcaaaacccttaccgttaagctacccgctaaagccgtagttgttttacagcttaataaataa

SEQ ID NO: 137 - protein, 397 aa, Microbulbifer degradans
MLLAQLPVKKYFVLLAIFSFMLGCNSAGVQQSAKSIQVAGTHSKPARFFAGADLSYVNEMEDCGATYRVNGVTTDPYQAFADAGANLVRVRLWHNPTWTEYSDFADVKKTIRKAKQNNQTVLLDFHYSDTWADPEKQFVPAAWEHMVDDTPALAQALAQYTTDVLEKLQAENLLPDMVQVGNETNAEVLQLEAHMKHGEIDWQRNAALLNSGLAAVAEFNQNNNTYIERVLHIAQPENALWWFDDAAQAGITDFEIIGLSYYAKWSTYKLDSIGEAIRALRTAFNKDVLVVETSYPWTMQNFDQANNVLDATSLQQGYPATAEGQKKYMMDLAKQIMYAGGIGIAYWEPAWVSTPCKTLWGTGSHWENAVFFDSGNNNEALPALSFYTDIMALFKQD

SEQ ID NO: 138 - DNA, 1194 bp, Microbulbifer degradans
atgttattagctcaattgccagttaaaaaatattttgtcttattagctattttctcgtttatgctggggtgtaatagtgctggcgtacaacaaagtgctaaatcaattcaggttgctggcacgcacagtaaacccgctcgtttttttgctggtgccgacctttcttacgtaaacgaaatggaagattgcggagcaacataccgcgtaaacggtgtaactaccgacccttaccaagcctttgccgatgccggcgcaaatttagtgcgcgtgcgcttatggcacaaccctacttggacagaatattccgactttgccgacgttaaaaaaactatccgcaaagccaaacaaaataatcaaacggtattgttagattttcattattcagatacctgggccgacccagaaaaacaatttgttccagccgcttgggaacatatggtggatgacaccccagcactagcgcaagccttagcgcaatacacaaccgatgtattagaaaagctgcaagcagaaaacctattgccagatatggtgcaagtaggtaacgaaacaaacgcagaagtcttacagctagaagcgcacatgaaacacggcgaaatagattggcagcgcaatgcagcgctactaaacagtgggttagcagccgttgctgaatttaaccaaaacaacaacacctatattgaacgcgtattacatatcgcccagccagaaaatgctttgtggtggtttgacgatgccgcgcaggctggcataaccgattttgaaattataggtcttagctactatgccaaatggtcaacgtataaattagattccatcggcgaagctatacgcgccttgcgaaccgcattcaataaagatgtgttggtggtagaaacctcatacccctggactatgcaaaatttcgatcaagccaataacgtgctcgatgctaccagcttgcagcagggctaccctgcaacggccgaaggccaaaaaaaatacatgatggatttagctaaacaaattatgtacgccggtggaattggtattgcctactgggaaccagcttgggtaagcaccccttgcaaaactctatggggtacaggttctcactgggaaaatgccgtgttttttgactctggcaacaacaacgaagcgctacccgcgcttagtttctacacagacataatggctctttttaagcaagattaa

SEQ ID NO: 139 - protein, 420 aa, Microbulbifer degradans
MLQILKDHGMDSIRLRVWVNPAGGWYSSINDVIEKAQRAKAAGMRIMIDFHYSDSWADPGKQYKPAAWTNYTLDGLMSAVWWHTYDSLVALKNAGITPEWVQVGNETNNGMLWEEGRASANMQNYAWLVNSGYDAVKEVFPNTKAVVHLANCHDNANFRWIFDGLQANGGKWDVIGASIYPTNASGYSWSQANSLCEANLNDMQSRYGSEVLIAEVGAPWDHPEAKAIVSDVIAKAQNAGATGVFYWEPQASNWQGYTLGAWNPNTMRPTEALDAFIDGSSNVTTARLQSRNSNRCIDVNGRSTADGADIIQWSCHSNANQQWTFEDMGNNYVRLRVGHSNKCLDVLGAGTADGDNVVQWACHNNANQQWLKEDMGDGYFRLKSRASGKCVDVNAGGANNGDSIIQWSCHTGWNQQWMVY

SEQ ID NO: 140 - DNA, 1263 bp, Microbulbifer degradans
gtgctgcaaattctaaaagatcacggtatggattccatccgtctgcgcgtgtgggtaaaccccgccggtggatggtatagcagcattaatgacgtaatagaaaaagctcagcgcgccaaagctgcgggcatgcgtattatgatcgattttcactacagcgactcttgggctgacccaggcaagcaatacaagcccgccgcgtggaccaactataccttagacggtttaatgtctgcggtgtggtggcacacctacgattccctcgtggccctaaagaatgcgggtattacccctgaatgggtgcaagtgggcaacgaaacaaacaacggtatgttatgggaagaggggcgcgcatccgccaatatgcaaaactatgcgtggttggtgaatagtggctacgatgccgttaaagaagtgttccctaataccaaggcagtggtgcacttggcaaactgccacgacaacgcaaacttccgctggatatttgacggcttacaagccaatggtggtaagtgggatgtaataggtgcctctatttaccctaccaacgcaagcggttatagctggagccaagccaacagtttgtgcgaggcaaacttaaacgatatgcaatcgcgctatgggtccgaggtgctaattgccgaggttggtgcgccgtgggatcacccagaagcgaaagcaatcgtgagcgatgtaattgctaaggcgcaaaacgccggtgcaacaggggtattttattgggagccgcaggcatcaaactggcagggctacacgctaggtgcatggaacccaaacaccatgcgccccaccgaagcattagacgcgtttattgacggcagctcgaatgtgacaaccgcgcgtttgcaatcgcgcaatagcaaccgctgtatagatgttaatggccgcagtacagcagatggtgccgatatcattcagtggagttgccacagcaacgccaaccagcaatggacttttgaagatatgggcaataactacgtgcgattgcgcgtgggccacagtaataagtgcttagatgtactgggtgcaggcactgccgatggcgataacgtagtgcagtgggcatgccacaataacgccaatcagcaatggctaaaagaagacatgggcgatggctacttccgcttaaaatctcgcgccagcggtaaatgcgtagatgtaaacgcaggcggtgctaacaacggtgattctattattcaatggagttgccacactggttggaaccagcaatggatggtttattag

SEQ ID NO: 141 - protein, 589 aa, Microbulbifer degradans
NDLSYVNEMEDCGAVYKDAGSVVDPYEVIANHGGNLVRVRHWNDPYWQALITQPESVAANWKANYSGLEDVTETIRRSKAAGMEVLLDFHFSDIWADPGRQTTPRAWENDFGDEDAMAAHIYDYVTSVLTGLNDEGLMPELIQIGNESNSGMMTTQNLIIEMNDAGTGLNVSKGGQTNYSDQYVARMYNSAISAVRDISEGMTNAPRIAIHVAGADKAVAFFDKLKSIGVTDIDIAGFSFYYGWEQAPIEDVASMIATLKERHPNLDPLMLETGYLWDEENIDSLGNIIGIADPAYLPVSKQNQLKYLTDLSQAVADAGGIGVVFWEPSWVSTECRTPWGQGSSHEHVAYFDHRDGLNFHIGGQWMEVTKLSETPEAGLATTFRVDMTGQDTSAGVFIRGAFTEDTLQPMLYEGENIYSYTTHIQAAQSGSYHYAIGLKNGTRETVPSECANPEDTLNRLYTVGENGEQLVTAVWASCDVFDPQAAGPTTLTLNVDMTGVDVSGGVYVAGDLNAWTITELTQVGASAIYTISYDLAVGAEGGYYFLNGSDWGDRETIPEECVGYYDADRGFLVEEQSPQVLDLVWSSCQ

SEQ ID NO: 142 - DNA, 1770 bp, Microbulbifer degradans
aacgacctttcctacgtaaacgaaatggaagactgcggcgcagtgtataaagatgcaggcagtgtagtagacccctacgaagtgatcgccaatcacggcggcaaccttgtgcgcgtgcgtcactggaacgacccctactggcaggcgcttattacccagccagaatctgtagcggcaaattggaaagctaattacagtgggcttgaagatgtaacagaaacaattcgacgatcaaaagccgccggtatggaagtgctgctcgactttcatttctcagatatttgggcagaccccggcaggcaaacaacgccgcgcgcatgggaaaatgactttggcgatgaagacgccatggctgcgcatatatacgattacgtaacatcagtactcacagggttaaacgacgaaggtttaatgcccgagcttattcaaattggtaacgaatctaactccggcatgatgacgactcaaaacctcattatagaaatgaatgatgcgggtacggggttaaatgtgagtaaaggcgggcaaacaaattactcagatcaatatgttgcgcgtatgtataactctgcgatttctgctgtgcgcgatattagtgaagggatgaccaacgctccgcgtattgctatccacgtggcaggtgcagataaagccgtcgcattttttgataagttaaaaagcatcggagtaacggatattgatatcgcgggcttctcgttttattacggttgggagcaagcaccaatagaagacgttgcaagcatgattgcaaccttaaaggaacgtcaccctaatttagacccgttaatgcttgaaacaggctacctgtgggatgaagaaaacatcgatagcttaggcaatattattggcattgccgaccccgcatatttacctgtgagcaaacagaaccaacttaaatatcttaccgatttatcgcaagcggttgctgatgctggtggtattggagtggtgttttgggagccatcttgggtatcaaccgaatgtcgcacaccttgggggcagggctcatctcacgagcatgttgcttacttcgatcaccgcgacggcttaaactttcatattggtggccaatggatggaggttaccaagttaagcgaaaccccagaagcggggctagctactacctttagagtggatatgactggccaagacaccagcgcaggggtatttattcgcggggcgtttaccgaagacacattgcagcccatgctatatgaaggcgaaaacatttatagttacaccacgcatatccaagcagcgcaaagcggaagctaccactatgcgattggcttaaaaaatggtacgcgcgaaacggttcctagcgaatgtgcaaacccagaagatacgttaaatcgtttatatacggtgggcgaaaatggggagcagttagttaccgcagtttgggcaagctgtgatgttttcgatccgcaagcggctgggccaacaaccttaacgcttaatgtagatatgactggtgtagatgtaagtggtggtgtgtatgttgcaggcgacttaaatgcttggacaatcaccgagcttacacaagttggcgctagcgcaatttataccattagttacgatttagccgtaggtgcagaaggtggctactacttcttgaatggcagcgattggggcgatagggaaacaataccagaagaatgtgtgggctactatgatgcagaccgcggctttttggtggaagagcaaagcccacaggtattggatttagtgtggagtagttgtcaataa

SEQ ID NO: 143 - protein, 339 aa, Microbulbifer degradans
MERTQTAMSDTPVNPNANTTTKAVYTYLKQQWGSKMLTGQMDLTWKDSIDEYQRVINDTGKAPAIMGYDYMNYGIESSFISGLEQTEEAIVHWQRGGLVTFAWHWRDPNVSGSNIGEFYTADTSFQIPIANGQLDESSQSFINMQADIDMIAAELQKLEDAGAVVLWRPLHEASGGWFWWGRTRTDSVSAAYAQVLLWRHMYTRLTDHHGLDNLLWVWNGQNSAWYPGDEYADIVSHDIYDGAKNYESQLAVYNDTKNTPMQTKMVALSENSNIPDPDAMQADGAWWLWFMVWNDSDTAEGVTHENNFWTGEYYNSNAHKQHVYNHELVITLDELPSFD

SEQ ID NO: 144 - DNA, 1020 bp, Microbulbifer degradans
atggagcgcactcaaacggccatgagcgatacgccggtaaaccctaacgccaataccaccaccaaggctgtttacacttaccttaagcagcaatggggcagcaaaatgctaaccgggcagatggatttgacctggaaggacagcattgatgagtaccagcgcgtaattaacgataccggcaaagcccccgcaattatgggctacgactatatgaattacggtattgagagcagttttattagtggccttgagcaaacagaagaagctattgtccactggcagcgcggcggcttagtgacttttgcttggcactggcgagacccgaacgtaagcggtagtaacattggcgagttttatacggctgatacgagctttcaaatcccaattgccaatggtcaactggatgaaagcagtcagagctttataaatatgcaggccgatatcgatatgatagcggcagagctgcaaaagctagaagatgccggcgctgtggtgctgtggcgccccttgcacgaagcttctggcggttggttctggtggggccgtacgcgtaccgattcggtatctgccgcttatgcacaagtgctgttgtggcgccacatgtacacccgccttactgatcatcacggtttagataatttactttgggtgtggaacgggcaaaacagcgcttggtacccaggcgatgaatatgccgatattgtaagtcacgacatttacgacggcgcgaaaaattacgagtcgcaattagccgtatataacgatacgaaaaacacccccatgcaaaccaaaatggtggcgctaagcgagaacagtaatattcccgacccagatgccatgcaggccgatggcgcttggtggttgtggtttatggtgtggaacgactcggataccgcggaaggcgtaacccacgaaaacaacttttggacaggtgaatattacaactctaacgcccataagcagcatgtttacaatcatgagctggttattacgctggatgagttacctagctttgactag

SEQ ID NO: 145 - protein, 561 aa, Microbulbifer degradans
MFNKISTPALSGWSKAARYLCHTATGALMLAASTVNAGFSVSGTQLLDDNGQAFIMRGVNHPHAWYANQTSSFADIASVGANTVRVVLSDGQQWTRNSASDVANVISLCKANKLVCVLEVHDVTGSGEASAAGTLANAAQYWVDIANVLKGQEDYVIINIANEPFGNNVPASNWINQHKAAIQTLRAAGLTHTLMIDAANWGQDWQQVMLNNASEVAQADSLSNTMFSVHMYQVYNNLSTVENYVSTFLSSHNLPLIVGEFGADHQGEEVDEDAILSVAEQYGIGYLGWSWSGNGSCCGTLDITNNFNVNSLTSWGNRLINGTNGIKATSVIASVYGGSSSSSSSSSSSSTSSSSSSSSTSSSSSSSGSSGGAQQCNWYGSVYPLCNNQASGWGWENQQSCIGRTTCESQSGNGGVIGGSSSSSSSSSSSSSSSSSSSSSSSSSSSSSSSSSSSSSSSSSSGGSGATCEHIITNSWNSGFQGAVRITNNGSSAINGWQVSWSYSDGTTIGSVWNANQSGSNPYTASNLGWNATVNPGQSVEFGFTANGGGAASAVTGSVCN

SEQ ID NO: 146 - protein, 61 aa, Microbulbifer degradans
MCSQVAPLPPDELLEEEELEDDELLLDELELLLDELLEELLDELLEELLDEDPPITPPLPD

SEQ ID NO: 147 - DNA, 1686 bp, Microbulbifer degradans
atgtttaacaagatatctacacccgcgttaagcggttggagcaaggctgcgcgctatttatgccatacggctactggcgcattaatgttggctgcaagtacggtaaatgcggggtttagcgtttcgggtacgcagctgttagatgataacggccaagcgtttattatgcgcggtgttaatcatccgcatgcgtggtacgccaatcaaaccagctcgtttgctgatatagcttcagtaggtgctaatacggttcgagtggtactaagcgatggccagcaatggacgcgcaacagcgcatctgatgtggcgaatgttatctcgctatgtaaagcaaacaagttagtgtgtgttcttgaggtacacgatgtaaccggttcaggcgaggccagtgcggcgggtaccttggcaaatgcggcccagtattgggtagatattgccaacgtgcttaaggggcaagaagattacgtaataatcaatattgccaacgaaccgttcggcaacaatgtgcctgccagtaattggattaaccagcacaaagcggctattcaaacgctgcgagcggccggtttaacccacacgctaatgatagatgcggcaaactgggggcaagattggcaacaagtaatgctaaacaatgcttcagaggtggcacaggccgatagcctaagtaacaccatgtttagcgtgcatatgtatcaggtttacaacaacttaagcaccgtagaaaactatgtgtctacgtttttaagtagccataacttgccgttaatagtgggggagtttggtgcagatcaccaaggtgaagaggttgatgaagatgcaattttatctgtggcagagcagtatggcattggctacttaggctggagttggtcgggcaatggcagttgttgcggcaccttagatataaccaacaactttaacgttaacagtttaaccagttggggtaaccgcctaataaacggtaccaatggtattaaagcaacctcggtaattgcatctgtatacggtggctcgtcgagcagttctagttcatctagtagctcttcaactagctctagcagttccagttcttctaccagttcatccagcagttcgtccggttctagtggtggtgcgcaacagtgtaattggtacggctcggtttacccattgtgtaataatcaagccagtggttggggctgggaaaatcagcaaagctgtattggccgtactacctgcgaaagtcagtctggtaatggcggagttattggcgggtcttcgtcgagcagttcttctagtagttcatcaagcagttcttctagcagctcatccagtagcagttctagctcatctagcagcagctcgtcgtcctcaagttcttcttcttctagtagttcatcgggcggcagtggtgcaacttgcgaacacataattacaaatagttggaacagcggttttcaaggggcggtgcgcattaccaataatggcagcagtgccattaacggctggcaagtaagttggagctacagtgatggcacaaccattggcagtgtatggaatgccaatcaaagcggtagcaacccttacacagccagcaatttagggtggaacgccacggttaaccctgggcagtcggtagagtttggttttactgccaacggcggcggtgctgcatcagcagtgacggggtcggtttgtaactaa

SEQ ID NO: 148 - protein, 514 aa, Microbulbifer degradans
MNNEEVNMRIFSIALALCAVLCAGQSLAGLSIQGTRLVDGNGSTVVLRGVNHPHAWYAGETAAAIPKIAATGANSVRVVMAMGTKWSRTSAAEIQTIIDLCKQNNMIAVLEFHDGTGWGEESGTAHISDIADYWVSSDVMAVVKGEEDYVIINIANEPFGNGVSASTYTNDTIAAIQKLRNAGYTHTLMVDAANWGQDWQNLMRDNAQTIFNGDSLNNTMFSVHMYQVYNTSAKVQSYMQAFSDKGLALVVGEFAADHFSEDVAEAAIMQYAEQFGFGYMGWSWTGNSSDLASLDIVKSFSDNTYTTWGNRLINGSNGIATTSRIASVYTGTSSGGSSSSSSSSNSSSSGGTSACSTGGSCDWSGTSFPLCENGNTNDWGYENGQSCVGVGLCDSNPDATTHCGTSSGGGSTSCGTTSDGHPVCCDAASDPDGDGWGWENEASCVVESGSSSSSSSSSSTSSSSSSSSSSSSSGGSSATCNWYGTQYPMCTSTSSGWGWENNQSCISPSTCSGQ

SEQ ID NO: 149 - protein, 52 aa, Microbulbifer degradans
MEHADVPPLLLELDDDEELELPPLDVPVYTLAIREVVAIPLLPFIKRLPQVV

SEQ ID NO: 150 - DNA, 1545 bp, Microbulbifer degradans
atgaataacgaggaagtcaacatgagaatattttctatagcgcttgcgctatgcgccgtgctttgcgcgggtcaatctttagctgggttatctattcagggtacgcgacttgtggatggcaatggcagcacggttgtgctgcgcggcgtgaaccatccccatgcgtggtatgccggtgaaacggcggcggctatccctaaaattgctgcaacaggtgctaactcggtacgggtagtgatggctatgggcactaagtggagccgcaccagtgccgcagagattcaaaccattattgacctgtgcaaacaaaacaacatgattgctgtactggaatttcacgatggcactggctggggggaagagagcggtactgcgcatatatctgatattgccgattactgggtgagcagtgatgtaatggcggtagttaagggtgaggaagactacgtaattataaatattgccaacgaaccctttggcaacggtgtatcggcaagcacctacaccaacgacacgattgcggctattcaaaaactgcgcaacgccggttatacccacacccttatggttgatgcggcaaattgggggcaagattggcagaacctaatgcgtgataacgcacaaaccatttttaatggcgactcacttaacaacactatgtttagcgtgcatatgtatcaggtgtataacacctcggcaaaagtgcaaagctacatgcaagcctttagcgacaaaggtttagcgttagttgtaggcgaattcgcagcagatcattttagtgaagatgttgcagaagcagccattatgcaatacgccgagcaattcggttttggttacatgggttggagttggacgggtaatagctcggatttagcatcgctagacatagtaaaaagctttagcgataacacctatacaacctggggcaaccgcttaataaacggcagcaacggtattgcgaccacttcgcgtatagccagtgtgtacacaggaacgtctagcggcggcagctctagttcttcgtcatcgtctaattcaagtagcagtggcggtacatcagcgtgttccactggcggaagttgtgattggagtggtacaagctttccattgtgtgaaaacggtaatactaacgactggggttacgagaatggccaaagttgtgtaggtgtaggtttatgcgattctaaccccgatgctaccactcactgcggtacttcttctggcggcggttctacaagttgcggcactaccagcgacggccaccctgtttgctgtgatgcagcctcagacccagatggcgatggctggggttgggagaacgaagccagttgtgtcgttgaaagcggtagctcttcgagttcatcaagttctagctctacgtctagttcaagttcgtcgagctcttcaagcagctcaagtggcggtagcagcgccacgtgtaattggtatggcactcaatacccaatgtgtacttctaccagtagcggctgggggtgggagaataaccaaagttgtatttcgccttctacgtgtagtgggcaatga

SEQ ID NO: 151 - protein, 457 aa, Microbulbifer degradans
MVNYLKRAALCMLALVAVACAKSQPETKVEELPATKTAANAGVAATEFVQVNGGRFTLRGQDYAYIGTNMWFAAYIGSTNPEYGDRERLIKELDLLKSLGVTNLRILGASEKSPLRDSMKPAISERGEINQHDILEGLDFALAEMAKRDMKAVIFLNNFWEWSGGMATYLSWVNGGEIVDMADPTKPWPAFALFSAGFYSNEEAKQLFNNYLTKVVSRRNTITGELYANDPTIMSWQLANEPRPGNGDVSKSNLPAYYDWISKTTQLIKSIAPKQLVSIGSEGTMGCLELDECVITAHKETGIDYVTFHMWLKNWGWFDVQNAEQTYDSAVATADKYIDHHIKLANELNMPVVLEEFGMERDGGEFSPESAVTYRDKFYAYVFDRQIKSIRSGGPFVGSNFWAWGGYGKAMHDDAVWRKGDKTFVGDPPQEPQGLNAVFASDTSTLEVLKQAADAIR

SEQ ID NO: 152 - DNA, 1374 bp, Microbulbifer degradans
atggtgaactacttaaagcgcgctgccctgtgcatgcttgcgctcgttgctgtggcttgcgccaaatcgcagccagaaacaaaagttgaagagctgcctgccaccaaaactgcggcaaatgccggtgtggcagcgacagagtttgtgcaagtaaatggtggccgctttacattgcgcgggcaggactacgcctacataggcactaatatgtggtttgccgcgtatattggttctaccaaccctgaatacggcgatcgcgagcgcctaattaaagaactcgatttattaaaatccttgggtgtgaccaacctgcgtattttaggagcatccgaaaaatctccattgcgcgattccatgaaaccggcaattagtgagcgcggtgaaattaaccagcacgatattttagagggcttagattttgcgttagctgaaatggctaagcgcgatatgaaagccgtgatatttctgaataacttttgggaatggtccggcggtatggcgacttacctaagctgggttaacggtggcgaaattgttgatatggcagaccccaccaaaccatggccagcttttgcacttttttcagcggggttttactctaatgaagaggcgaaacaactattcaataattaccttacaaaagttgtaagccgccgcaataccattaccggcgagttgtacgctaacgaccccactattatgtcttggcagctcgctaacgagccgcgcccaggtaacggcgatgtgagcaagtctaacttacccgcctattacgattggataagtaaaaccactcagctaattaaaagcattgcccctaagcagttggtgtcgattggtagcgaaggtaccatgggctgcttagagttggatgagtgcgttattaccgcccacaaagaaacaggtatcgactacgttacattccatatgtggcttaaaaactggggctggttcgatgtgcaaaacgcagagcaaacctacgacagcgcagttgctactgcagataaatatatcgatcaccacattaaactggctaacgagttaaatatgccggtggtgctggaagagtttggtatggagcgcgacggaggtgaattctccccagaaagcgcggtaacctatcgcgataaattctatgcctatgtgttcgatcgccaaattaaaagtattcgctctggcgggccgtttgtagggtccaacttttgggcgtggggcggttatggcaaagccatgcacgatgatgctgtatggcgcaaaggcgataaaacctttgttggtgacccgccgcaggagccgcaaggtttaaatgcggtatttgcttccgatacttcaacgctggaagtgttgaagcaagcggcggacgctattcggtaa

SEQ ID NO: 153 - protein, 850 aa, Microbulbifer degradans
MNTKIKLLSFLASAMLLQACGGDMLGTSDSEDYKLIPEEVTEDPTKARPSENAPVLKTSGTTIQLPDGTPVLLRGINLQFGDNPIEQIDGIQAIRETGSNVVRIQLLADTSTANLEAVLNKVVEHNLIAVLSLYDEALHCKEDDEAFTDAVKQVWLTDFLPIIAQDRYQANIMINIASGWGPEAIFDGYSVGYKTYTDNYKAAIRQFRKAGFNVPLVIDAPGCGADFNAFLSNRGKELMAADDKDNLVLSVHGYGSQWNTATKVTDAISQLAAQNIPVLMSEFGGSGVGEKPVKHMAILDKGAGDYAAEIILPWASATDKVAMNVPFSAPINLTNTDVSFDVKLDEAYVTDGQMGVVMYLRDVNGEYANLAWHSASEFPAGEWATKSYAIQNNASFGWASEAFDITAVAKVGVELVANGKLAEVAGSVVIDNLRVAEGSGAVELYSQSFDDDIAGWGVPWTGTVAAHADGALSLTHDNGEIIAQLDGLGGVVDFAQPVVISGRFFVPADYAGSWMYAKFFNNGEAWTEVGITGLTPGEWTEISVETEFPAAATSVGIQIGNIGIADGATITDSTEPFLLDDFAISGVAANDSFELGTQYMASFDESEDGWAYLSWGASATVEAIDGALNFYPNANDAVRIVLYKTDLSAIDDLDLQDPFTIKTRVLIPDSYTGQAFEYQLFLQDANWQNHFAAKIWNQDELIPGEWMDLVVEVEFPAEFDRAGIPQYLGFDLSSEVALPQDPILIDEIVFEGMVPVEKEVVIIDQVDFFYTNHFTDFAIDYIEGEILEDDILELAYIHQRSEPFSWIAWSWYGNDIENSDWDMTTIVGDATALTERGEDIVNGKGGIAGN

SEQ ID NO: 154 - DNA, 2553 bp, Microbulbifer degradans
atgaacacaaaaataaaattactttcatttcttgcgagtgcaatgctgttgcaggcatgtggtggtgacatgctgggcacctctgacagcgaagactataaattgattccagaagaagtaacggaagatccaactaaagctaggccgtctgaaaatgcccccgtgttaaaaacgagtggtactactatacagctaccagatggtacaccagtgctgctgcgaggtattaaccttcaatttggcgacaatcctattgagcaaatagatggcatacaggctattcgcgaaacaggttcaaacgttgtgcgaattcaattgttagcagatacatctacagcaaatttagaggcggtgctaaataaagttgttgagcataatttaatagctgtacttagtctctacgacgaagctttacattgtaaagaagatgatgaggcatttacggatgcagttaagcaagtatggcttaccgattttcttccaattattgctcaagatcgttatcaagcaaatattatgattaacatcgcaagtggctgggggcctgaagccatttttgatgggtatagtgtaggttacaaaacgtataccgataactataaagcagctattcgtcagttccgaaaggctgggtttaatgtgcctttggtaattgatgcccctggatgtggtgctgactttaacgcttttttaagtaatcgcggtaaagagcttatggctgcggatgataaagacaatcttgtgttgtccgtgcacggttatggttcgcagtggaacacggctactaaagttacggatgcaattagccagcttgctgcgcaaaatatccctgtgctaatgagcgagtttggtggctctggtgtcggtgaaaagcctgttaaacatatggcgatccttgataaaggtgcaggagattacgccgcagaaattattctgccatgggcgagcgctacagataaagtggctatgaatgtgccattctcagcacctatcaatctgacaaacactgatgtgagctttgacgttaagctggatgaagcatatgtcacggatggtcaaatgggggttgtaatgtacctccgagatgtaaatggagaatatgcaaacttagcttggcactctgcctctgaatttccggctggtgaatgggctactaaatcttatgcgattcagaataatgcatctttcggctgggcaagtgaggcgtttgatattactgccgtcgctaaagttggtgttgagttggttgcaaatggcaagctcgccgaggttgctggcagcgttgttatcgacaaccttcgagtggctgaaggtagtggtgcagtcgagttatacagtcaaagctttgatgatgatattgcaggttggggcgtgccttggactggcacagttgctgcgcacgctgacggtgctttatcgctaacccatgacaatggagaaattattgcccagctggacgggcttggtggtgtagttgattttgcccagccggttgttattagtggcaggttttttgtgcctgcggattatgctggttcatggatgtacgctaaatttttcaataacggcgaggcatggacagaggttggaattactgggcttactcctggagagtggacagaaatttccgtcgaaaccgaatttcctgcagctgctaccagtgtaggcattcagattggcaacataggtattgctgatggggcaaccattacagattccacagagccttttttgctggacgactttgctataagtggcgtagcagctaatgactcgttcgaacttggtacgcagtatatggcgtcgttcgatgaatctgaagatggctgggcttacttgagttggggggcgtctgctactgtagaggccattgatggcgctttgaatttctatccaaatgccaatgatgcggtgagaatagtactttataaaaccgacttaagtgctatagacgacttggatttgcaggacccgttcaccattaaaacgcgagtattgattccagatagctacacaggacaggcgttcgagtatcagctgtttctacaagatgctaactggcaaaatcattttgcagcgaaaatttggaaccaagatgagcttatccctggtgagtggatggacttggtggttgaggttgagtttcctgctgaattcgatcgggctggaattcctcaatacctcggttttgacctgtcctccgaagttgctttaccacaagacccaatactaattgatgaaatagtttttgaaggcatggttccagtagaaaaagaagttgtgatcattgatcaggtagatttcttctacactaaccactttacagattttgctatcgactatattgagggtgaaatattagaggacgacattctggagcttgcttatattcatcagcgcagcgagccattctcttggatagcttggtcttggtacggaaatgatatcgaaaattctgactgggatatgaccaccatagttggcgacgcaacagccttgactgaacgtggtgaagatatcgtaaatggtaaaggtgggattgcaggtaactag

SEQ ID NO: 155 - protein, 408 aa, Microbulbifer degradans
MQKITRLAALVVAGLCLLGTQAQAKKFEHLAQTPPMGWNSWNNFGCDVDEKLIKETADYMVSSGMKDAGYEYVNIDDCWHGERDANGFIQADPERFPSGIKALADYVHSKGLKFGIYSDAGWTTCGGKPGSRGYEFQDAQMYAKWGVDYLKYDWCATDGLKAEGAYQTMREAIHKAGRPMVFSICEWGDNQPWEWAKPIGHLWRTTGDIYNCFDCEYDHGTWSSWGVLQILDMQDDLRQYAGPGHWNDPDMMEVGNGMTEAEDRSHFSMWAMLAAPLIAGNDIRNMSEATRKILTNKAVIAVDQDELGVQGFKYSSKNGVEVWFKPLANDEWAMAVLNRNKGEVKFEFKWRNEVVKDELTHRTITFNEQKFDWQDLWNKSNKGHTKKFLKTKIAGHDTLMFRLTPAKN

SEQ ID NO: 156 - DNA, 1227 bp, Microbulbifer degradans
atgcaaaaaattacacgtttagcggcgttagtcgtcgctggcttgtgcctgctaggtacgcaggcgcaggcgaaaaagtttgaacacttagcccaaaccccgcctatggggtggaatagctggaacaattttggctgtgatgtagatgaaaagctcatcaaggaaacggctgattatatggtttcttccggcatgaaagacgcgggatatgagtatgtaaacatagacgattgctggcatggtgagcgcgatgctaatggttttattcaggcagaccccgagcggtttccttccggtattaaagcgcttgccgactatgttcattcgaaggggctgaagtttggtatttattctgacgcgggttggaccacctgcggcggtaaaccgggcagtcgtgggtacgagtttcaagatgcacaaatgtatgcgaaatggggcgtggattatcttaaatacgattggtgcgctacagatggcttaaaggccgaaggcgcatatcaaacaatgcgtgaagccattcataaagccggtagaccaatggtatttagcatttgcgagtggggcgacaaccagccttgggagtgggccaaacctattgggcatctatggcgtaccacgggtgatatctacaactgtttcgattgcgaatatgaccacggtacttggtcttcctggggtgtattgcaaattttggatatgcaagacgacctaaggcagtacgctgggccaggccattggaacgaccccgatatgatggaggtgggcaatggcatgactgaagctgaagaccgttcgcatttttcaatgtgggctatgttggcagcgccccttattgctggtaacgatatacgcaatatgtcggaagctaccagaaaaattctcaccaataaggccgtgatagcagtcgatcaggacgagctaggcgtacagggctttaaatattccagtaaaaatggcgtagaggtttggtttaaaccgttggcgaatgatgagtgggcaatggctgtactcaaccgaaataaaggtgaagttaaattcgagtttaagtggcgtaatgaagtggttaaagatgagctgacgcatcgcactattacgttcaacgagcaaaaatttgactggcaagatttgtggaataaatccaacaagggccataccaaaaaattcctaaaaacaaaaatagctgggcacgatacgctgatgtttaggctaacgccggctaaaaactag

SEQ ID NO: 157 - protein, 1733 aa, Microbulbifer degradans
MSCTPCIRSKASSLNFDNKLIKSEFIMSNQKRLSAGLIAKLALASGLTLVATAATHADVTNPVIGNLIFEENFNTLNSDRWNVIEGDGCQYGPNLCGWGNQELQYYQDSNVTIEDVPGEPGNKAVVFEARNETVNGSAFTSGKIDSEDGIAIKYGMIEFRLRVPNMGVGYWPAVWMLGTSTESWPSKGEIDMMEMGHRAQGMADAGHPGTNLNNYTAANAIFYAEAACVPENPTCAAMTAWQTDNAYVSQTSMGERFVIYRTYWTDTQLRFTVIDNGVEYDMYDDPITIGEEATELQQPFYLLANLAVGGNFTDASTPAEVTAQLPGKMYLDYIRVYQLDGMGEIFEGSIAQKEYGTFGVFTDDTPTSNKLVAGDTSQIYIWNQNSLSEGTLAPAEGDNVIAWNYTAPEWFGAGIQAVHARDMSNFENGEFKFKIKIPANVSFKVGFADTYTNENWLTFPANQTTYGLVRNGEWAEATIPVADLRGSLIALQSMAGMFYIASVDGQIPTSNFEFAIDDVRWEGGGAGPVDSDGDGVADELDQCPNTPAGTAVDSVGCQIGLPQPVAVTVEAEDYEAYYDTTSGNSGNAYRSDDVDIEAASEGGFNVGWTDAGEWMDYTLNLAAGTYDVTARVASNTDTGVYSVSLDGTTIGSNGVATGGWQNWVTQVVGQITVNGGQQTLRISTDVAGYNINWVHFEPVPDADNDGVPDSQDNCPNTPAGTEVDANGCAIVVDPVPVHIEAEDYAAYHDLSAGNNGGQYRSDDVDIEAASEGGFNVGWTDTGEWLEYSVELIEGVYDLTARVASLSGNGAYSVSISGQAVGGSNAVATGGWQNWETQHVARFVAGTGTYTIRVNADAGGFNLNWLHLEPVNDPDSDNDGVPDSQDNCANTPAGTEVDASGCPVVVQPFGVTQSDSNSAQFYVNGADWAVLHYSVNGGGQVNVSMSLENGKHVYTVPDLAPGDSISYFVTYWDPELGGARDSETVSYSVVAAGSDSDGDGVGDSADQCPNTPAGTAVDSVGCPVTQPPSDSDNDGVTDANDQCPNTPAGTSVDSVGCPVVQPPSDSDNDGVDDSSDQCPNTPAGTSVNAVGCPVTQTNIVPLYNASTNLEGAISFDRGDALVTRISDRGRDRHAKENHFQAYDHYLTFYWEDRTIAIEIVDYVAKGGSSIRMNIVSQMRLDDTEAENRWFYIGNNTLAEYCGNGVMNEVDHTHYWKESSFNCREGRPIQIGDKMEFEISQFLDPALLPRGRSNYYGTTYLYIVGEGLVPWDVTDKVAFQGGNRLQRDSIPVPEHARLGGDTTLHVQMTAEPDGHFQQMATNLGFDNGQPFVLGRRVHHTSYVDGTHDESAENGVFDGMPGKAGPHYVNDRCSDCHERNGRAPVVGIGEPLDRWVFKVGDANGNPHPDMGRVLQPEANNGAASEGTPTIAFFSEENGLRKPNYAFSGITPDTFSARIAPQLNGIGLLEAIPESAILAQEDVNDANGDGISGKAQRSIDPVTGETRLGRFGYKAATSSVKHQVAAAFNTDIGVRTSVMPNPDCGSNQNDCGPSGAELADEHLDNLVKYVSLLGVRPQRDYNDAQVLQGKQVFNDAGCVSCHTDTYQTSQYHPLAELRSQTIHPYTDLLLHDMGPGLADNLGEGDATGAEWRTAPLWGLGLSACVTGGVEGGRGWDDFGLDGYETCTPHHSYLHDGRARTIEEAILWHGGEGENSKQAYQNLSNSERDALLAFLNSL

SEQ ID NO: 158 - DNA, 5202 bp, Microbulbifer degradans
gtgagttgtacaccctgtattagatcaaaagcttcatcacttaacttcgataataaacttataaaaagtgagttcatcatgagtaaccaaaagcgattgtccgctgggttaattgcaaagttagcgttggcttcaggccttacgctagtcgccactgcggccacccacgccgacgttaccaatcctgttattggtaatttaatctttgaagagaatttcaataccctcaacagcgatcgttggaatgtgattgagggtgatggctgccaatacggcccaaacctttgcggttggggcaaccaagaattgcagtattaccaagatagcaatgtaaccatcgaagatgtgcccggagaaccgggcaacaaagcggttgtttttgaagcgcgcaacgaaactgtaaatggcagtgcgtttacatccggcaaaattgattcggaagacggaatagccattaagtacggcatgattgagttccgtttgcgagtaccaaatatgggcgttggctattggcctgcggtttggatgcttggcacaagcacagaaagctggccgagcaaaggcgaaatagacatgatggaaatgggccatcgtgcccaaggcatggccgatgcgggccacccaggcacaaacctaaacaactacaccgcggccaatgcaattttttatgcagaagcagcctgtgtacccgaaaaccccacctgtgcagccatgaccgcatggcaaacagataacgcctatgtttctcaaacgtctatgggcgagcgatttgttatttaccgcacttattggaccgacacccagttgcgttttaccgtaattgataatggcgttgagtacgatatgtacgatgatccaattactatcggcgaagaggctactgagctgcaacagccgttttatttgttggcaaacttagcagttggcggcaattttaccgatgcgtctacacctgccgaagttaccgcacagctgcccggtaaaatgtatttagactatattcgtgtgtaccaattagacggtatgggcgaaatattcgaaggctcaattgcccaaaaagaatacggcacatttggtgtgtttaccgatgacacgcccaccagcaataagctggtagccggtgatacgtcacaaatttatatttggaatcaaaactccctaagtgaaggaacgcttgcgcccgccgaaggcgacaatgtaatagcctggaactacaccgcgccagagtggttcggtgctggcattcaagctgtgcacgcgcgcgatatgagtaattttgagaatggcgagtttaaattcaaaataaaaatacccgctaacgtctcatttaaagttggttttgcagatacttacaccaacgaaaactggctaactttccctgctaatcaaacaacctacggtttggtgcgcaatggcgaatgggctgaggcgacaattccagtagcggacttgcgcggcagtttaattgcattgcagtctatggctggtatgttttatatcgccagtgttgacggccaaattccaacgtctaattttgaatttgccatcgacgatgtgcgctgggaaggcggtggtgcagggcctgtagacagcgacggcgacggcgtagctgatgaacttgatcagtgccccaacacaccagccggtactgcagtagatagcgttggctgccaaataggtttgccacagcctgtggctgtaacggtagaagcggaagactacgaagcttactacgatacaaccagtggcaactctggcaatgcgtatcgcagcgatgatgtagatatagaagctgcaagcgaaggtggttttaacgtcggttggactgatgctggcgagtggatggattacactttaaacctcgctgcgggcacctacgacgttacagctcgtgttgcttcaaataccgatactggtgtgtacagtgttagtttagatggcaccacaatcggctctaacggagttgcaactggcggttggcaaaactgggttactcaagttgtcggccaaattacggtaaatggcggtcaacaaactctgcgcattagtactgatgtggctggatataacattaactgggtgcattttgagcccgtgccagacgcagataacgatggcgtacctgacagccaagataactgccccaatacaccagcgggtacagaggtggatgctaatggctgtgcgattgtcgtagacccagtacccgtgcacatagaagccgaagattacgcggcctatcacgacctatctgcaggtaacaatggcggtcaataccgctctgatgatgtggatattgaagccgctagcgaaggtggattcaacgtaggttggacagatactggcgagtggttggaatactcggttgaattaattgaaggtgtttatgacctaactgcacgcgtggcatcgttaagcggcaatggcgcttacagcgtttctatttctggtcaagctgtgggtgggtctaatgctgtagcgactggtggttggcaaaattgggaaacccagcacgtagcgcgttttgttgcaggcacgggtacctacactattcgtgtaaatgcagatgccggcggctttaaccttaattggttgcacttagagccagtaaacgaccccgatagcgataacgacggtgtgccagacagccaagacaactgcgccaatacccctgccggcaccgaagtggacgccagcggttgcccggtagttgtacagccatttggtgtgactcagtcagattccaacagcgcgcaattttatgtaaatggcgccgactgggcagtgttgcattacagtgttaatggcggtgggcaagtgaatgtgtccatgagtttggaaaacggtaagcatgtatataccgtgccagacttggccccaggtgactccattagttactttgttacctattgggacccagaactaggcggtgcacgcgacagtgaaacggtaagctacagcgtagttgctgcgggtagcgatagtgatggcgacggcgtaggtgatagtgctgaccaatgcccaaatacacccgccggcacagctgtcgattctgttggttgcccagtaacacagccaccatccgatagtgacaacgatggcgttacggatgctaatgatcagtgcccaaatacacctgcaggtacatcggttgattccgttggctgcccagtggttcagccaccatcagatagcgataacgacggtgtggacgattcaagtgatcaatgtccaaatacccctgcgggtaccagtgtaaatgcagtgggttgccctgtaacgcaaactaatattgtgcctttatataatgccagcacaaacttagaaggcgctatttcttttgatcgcggtgatgcgcttgttacgcgaatttcagatcgcggtcgcgaccgtcacgcaaaagaaaaccacttccaagcttacgatcactaccttactttctattgggaagatcgcactattgctattgaaatagtggattacgttgcgaaaggtggcagcagcattcgcatgaatatcgtaagtcaaatgcgtttggatgacaccgaagcagaaaaccgctggttttatattggtaacaacacgctcgctgaatactgtggcaatggcgtgatgaacgaagtggatcacacgcactactggaaggaatctagctttaactgtcgtgagggtcgtcccattcaaattggcgataaaatggagtttgaaatcagccaatttttagaccccgcgctattacctcgcggtcgctctaattattacggcaccacttacctttacattgtgggtgagggcttagtgccttgggatgttaccgataaagttgctttccaaggcggcaaccgtttgcagcgagattccattcctgtgcccgagcacgcgcgtttaggtggcgatacaactttgcatgtgcaaatgactgccgagccagatggccacttccagcaaatggcaaccaacctgggttttgataatggccagccgtttgtactcggtcgccgtgtgcaccacacatcttacgtagatggtacgcacgatgagagcgcagaaaacggcgtatttgatggtatgccaggtaaagcaggcccgcactatgtgaatgaccgctgctcggattgtcacgagcgcaatggtcgtgcaccggttgtgggtattggtgaaccgttagaccgttgggtgtttaaagtgggcgacgcaaatggtaacccgcatccagatatggggcgcgtattgcagccagaagcgaacaacggtgccgctagcgagggcacgccaaccatcgcattctttagcgaagaaaacggtttgcgcaaaccaaactatgcatttagcggcataacgccagacactttctctgcgcgtattgccccacagctaaatggcattggtttgctcgaagcgattccagaaagtgcaattttagcgcaagaagatgtgaacgatgcgaacggtgatggtatctccggtaaagcgcagcgctctatcgaccctgtaaccggtgaaacccgcttaggtcgctttggctacaaagcagcaaccagcagtgtaaagcatcaagtggctgcggcgtttaatacggatataggtgtacgtacctctgtaatgcccaacccagattgcggctcgaatcaaaacgattgtggcccaagtggtgcggaactagcagatgagcatttagataaccttgttaagtatgtttctttactgggtgttcgcccacagcgagactacaacgatgcgcaagtactacagggtaagcaagtgtttaacgatgctggctgtgtgagttgtcataccgacacttaccaaacatcgcaatatcacccgcttgcagagttacgcagccaaactattcacccctacacagatctcttgctgcacgatatgggcccaggtttggccgataacttaggtgaaggcgatgcaacgggtgccgaatggcgtaccgcgccgctttggggcttaggtttgtctgcttgtgttacgggtggtgtagaaggtggtcgcggctgggatgattttggcttagatggctacgaaacctgtactccacatcacagctacttacacgatggtcgcgcacgcaccattgaagaagctattttgtggcacggtggcgaaggtgaaaactcgaagcaagcgtaccaaaacttaagcaatagcgagcgcgatgctctactcgcattcttaaattccctctaa

SEQ ID NO: 159 - protein, 1441 aa, Microbulbifer degradans
MTTRNTFKLSKLLLSLGVLTASSQLVAQDLIWSDEFEGDKIDRSIWSYNVGGSGNGNGELQYYTANATNSRIEDGNLVIEARREEMEGKQFTSARLHTNGRFSFKYGTLEARIKLPKLDDGLWPAFWTLGDNFGVDGWPKSGEIDILEAGYKAAREAGTTNTAVSGAVHWWHESGDWSDWLQADAHAETHVTTPMNEAYHTYRLEWTPSELSISVNDNTYFTMDITDPNMSEFHGAQHLLLNLAVGGWNFVEIEDPALITADFPAQMLVDYVRLYSNEFTEVFDANENLPTGDFGVMTDLTPVFNELNWGDRMHLYIWNNMEVAGIDPYEGTSVLAYDVAPDAWWGMGLLHKDYNMRNYKHGYLHFMMKTTATSDISINMASTSGGEGAVVLANGGEEYGLERDGEWHEVNIPLAKFGAMDFETIKTFFSMSGPGQAEAFQIAVDDIYLKSSIALPRPEFGSFGIYTESPENMSAGNFGFGVEGDLFLWADTLELLPGEVVEGNASLHLKSTGQGWFGMGLTAREGFNLSAFDNADAKLHLSMKTTDQTDFQVGIKSGSVNDIGQVWIKFTPGNDPYGFARDGQWHDLVIPMSDIAQDLDMFDVRQVFQLLGFGEIESLAIDNIYISGGGASTPEIVNPSEPVNRAPMAAIKPSVNGGPATLSVDFDASQSGDVNGDALTYTWDFGDGTTATGVQVSHDFEKEGNYRVSLIVSDGQATDETAAIITVDDNYGLSRSDKRGLGFGHHSVADFEAISQGISWWYNWSIKPDSLIQDVYQNYGVEFVPMAWNGGFDDQAMRDYINAHRDDVKYILAFNEPNFLEQANMTPSQAAAEWPRLEAIADEFGLKIVSVAMNFCGNCVTENGTTYYDPIDYFDDFFEVCPDCRVDALSIHAYMGGVGGIEWYIDLFAKYNLPIWMTEFSAWDDTTTEEEQIFFMTQAVDYMEQHENVERYAWFTGRRNGHPYNGLFDYRQSGVLTELGSAYINMPVHGEDSIHTLPKHIEAEAYAYQSGGRVAPTTDANGFLQMGENAAGSWVEYNVINPATRSYNVAVRVNSETGGTITVLVDGVEKGQIPVPAAADAQAWATVDTDLEITAGEHDVRLVFGASVNLNWLNIGDALSPELEPEPEPEPEPEPEPEPEPEPEPEPEPEPEPEPEPEPEPEPEPEPEPEPEPEPEVDPTAPLACTATASSQEGALAPSFVCDGDAGTRWSSEWNDNETITLDLGDVYEISSINLTWENAYGSKYDILVSDDNVHWTLAYSEQAGDGGIDNLAVTATGQYVRLLGLERGIGYGFSLFSFDVYGALKPVVVVPEGDLALGKPTSASSSEWAEPTAANATDGNTGTRWASAWTDSEWISVDMGEVYPVGRVVLNWEGAYGKGYNIQTSNNGADWTTVYTETAGDGGTDEIILPFASGRYIRVLGTERGTGYGYSLWDFEIYAD

SEQ ID NO: 160 - DNA, 4326 bp, Microbulbifer degradans
atgacaacgcgaaatactttcaagctgagtaagctcctgctttcgctaggtgtacttaccgcttcttcgcaactcgtcgcccaagacctaatttggtccgacgaattcgaaggcgataaaattgaccgcagcatatggtcttacaatgtgggtggtagtggtaacggcaatggtgagttgcagtactacaccgccaatgccaccaattcacgcattgaagacggcaacctcgttattgaggcgcgccgcgaagagatggaaggtaagcagtttacttctgcacgtctccatacaaatggtcgcttttcttttaaatacggtaccttagaggcaagaattaaattgcctaagttagacgatggcctgtggccagcgttttggactttgggtgataactttggtgtagacggctggccaaaatctggtgagatcgatattttagaagccggctacaaggctgcgcgcgaagcgggcaccaccaatactgcggtgtctggtgctgtgcactggtggcacgaaagtggcgattggagtgattggttgcaggccgatgctcatgccgaaacgcatgttacaacgcctatgaacgaggcgtatcacacctatcgtttagagtggactcctagcgagctatctatttctgtaaacgacaatacctatttcaccatggatattaccgacccaaacatgtcggaatttcacggtgctcagcatttgctgcttaacttggctgtaggtggttggaactttgtagaaattgaagacccagcgcttattactgcagatttccctgcacaaatgcttgtggactacgtgcgcttatacagcaacgaattcaccgaagtgtttgacgcaaacgaaaacttaccaaccggtgacttcggcgtaatgaccgatttgacccccgtgttcaatgaattgaactggggtgatcgtatgcacctgtacatttggaacaatatggaagtagcgggcatagacccgtacgaaggcacttctgtattggcttatgatgtggcgccagatgcgtggtggggcatgggtcttttgcataaagactacaacatgcgcaactacaaacacggctacctgcacttcatgatgaagacaaccgctacctccgatatcagcattaacatggccagtacctctggcggtgaaggtgctgttgtattggcaaacggcggtgaagagtacggtttagagcgcgacggcgaatggcatgaggtgaatattcctctggctaaattcggcgcgatggatttcgaaaccatcaaaactttcttcagcatgtctggcccaggccaagcagaagcattccaaattgctgtggacgacatttatctaaaaagcagtattgctttacctcgcccagagtttggcagcttcggtatttacaccgaaagcccagaaaatatgagcgcaggtaactttggttttggtgtagaaggtgatttatttctttgggctgataccttagagctattgccaggcgaagtggttgaaggcaatgcatcactgcatttgaaatcaaccggtcaaggttggttcggtatgggcttaacggctcgcgaaggctttaacctttctgcgtttgataacgccgatgcgaaattacacctctcaatgaaaaccacagatcaaactgatttccaagtgggcattaagagcggcagcgtaaacgacatcggtcaagtgtggattaagtttacccctggtaacgacccatacggtttcgcacgcgacggtcagtggcacgacttagttataccgatgtctgatatcgcacaagatttagatatgttcgatgtgcgtcaagtatttcaattgttaggttttggcgaaatagaaagcctcgcaattgacaatatttatattagcggtggtggtgcatctacaccggaaattgttaacccaagtgaacctgtaaaccgcgcaccgatggctgcaattaagccttctgtaaatggcggccctgcaacattgagtgttgatttcgacgcgagccaatctggcgacgtaaacggcgatgcgcttacctatacctgggactttggtgacggtactactgcaaccggcgtacaagtaagtcacgactttgaaaaagaaggtaactaccgcgttagcttaattgtaagcgacggccaagcgacagacgaaactgcagccattattactgttgacgataactacggtttatcgcgcagcgataagcgcggacttggttttggtcaccactcagttgccgacttcgaagctatttcgcagggtatttcttggtggtacaactggtctattaagccagattcactgattcaagatgtttaccaaaactacggcgtagagtttgtacctatggcgtggaacggtggttttgacgatcaagcaatgcgcgattacatcaatgcgcaccgcgacgacgttaaatacattcttgcgttcaacgagcctaacttcttagagcaagccaacatgacgccttcgcaggcggcagccgagtggccacgtttagaagccatagccgatgagtttggtttgaaaattgtttccgttgctatgaacttctgtggcaactgtgtaacagaaaatggcactacctattacgaccccattgattactttgacgatttcttcgaagtgtgccctgactgccgtgtagatgcgctttctatccatgcttacatgggtggtgttggcggcatcgagtggtatatcgatctgtttgcaaaatacaaccttccaatttggatgaccgagttttctgcatgggacgataccaccacagaagaagagcaaatcttctttatgacccaagcagtagactacatggagcaacacgaaaatgtagaacgctatgcgtggttcactggtcgtcgcaatggtcacccgtacaacggtttgtttgattaccgccagtcgggtgtacttaccgagctaggcagcgcgtacatcaacatgcctgtgcacggtgaagacagcattcacactttaccaaagcatattgaagcagaagcttacgcttaccaaagcggtggacgtgtagcacctactactgatgcaaatggcttcttgcaaatgggcgagaacgctgctggctcttgggttgaatacaacgtaataaacccagcgactcgcagttacaacgtagcggtacgtgtaaacagcgaaaccggcggcaccattaccgtattggtagacggtgttgagaaaggccaaattcctgtacctgcagcagctgatgcgcaagcttgggcaactgtggataccgatttggaaattactgcaggtgagcacgatgtgcgcttggtatttggtgcaagtgttaaccttaactggttaaacattggcgatgcgttaagcccagaactagaaccagaaccagaaccagaaccagaacctgaaccagagcctgaaccagaacctgaaccagagccagaaccagaaccagaaccagaaccagaaccagagcctgagccagagccagagccagagccagagccagagcctgagcctgagccagagccagaagtagacccaactgcaccattagcgtgtaccgctacagcctcatcgcaagaaggcgcgttagcaccaagctttgtgtgtgatggtgatgccggcacccgttggtcatccgagtggaacgataacgaaaccattacgttagacctaggtgatgtttatgaaatatctagcattaacctaacgtgggaaaatgcctacggaagcaagtacgacatattggtttcggacgataacgtacactggacgcttgcctacagcgaacaagctggcgatggcggtatagataacttagcagtaacggctactggccaatacgtgcgcctgcttggtttagagcgcggcattggttacggcttctctctgtttagtttcgatgtttacggtgcactaaaacctgtagtggttgtaccagaaggtgatttggcgttaggtaagcctacgagtgcttcttcatcggaatgggcagagccaaccgccgctaatgcaaccgatggcaacaccggcacgcgttgggccagtgcttggacagacagtgagtggatttctgtagatatgggtgaagtgtatcctgttggtcgagtggtacttaactgggaaggtgcatacggtaaaggctataacattcaaacctcaaacaatggggctgattggactaccgtttacaccgaaaccgcaggcgatggcggtacagatgaaattattctgccattcgcgtctggccgctatattcgtgtactaggtaccgagcgtggcacaggttacggttactcactgtgggattttgaaatctacgcagattaa

SEQ ID NO: 161 - protein, 1207 aa, Microbulbifer degradans
MQPSAYGLYCAACYSQKSKCEFIMIKNNLIKYAVRCAALGALSTSAVHVSATDYNDPYWTNPEVNSDFVDNFNQTQIDRSKWLVETNIFVNGEDIDYQDVEYPQADWTIGVGQDDPAAIDGKALILKARYMDGEVQDYYGGDPANPGKPLFIRSGRIESQITDDTTFTYGKFEARLKMPPARNGEFPAWWLLGNFPDVGWTACQELDIMEFTGNNGMNIPQTYWTAPYAVHGGTTVGLAGLGITNPQEQYVTYGIIKTPSKVEWYINGVLTNTFSRDNQGDDQPWPYVTPMRMILNHAITHVEWPDVGNYNAYSPDANRPSATGWSYVDNNGVTQYEYIDVDAMNANIGRAGTDFVVDYVAHWPLPTSDAEHKYVDDSKSSFFRESGNTKGFYNLKGWLAPVSVTADGFDQPGWDTDVRDNGADNAADGYVGSKWATPNDDGIHWVEVDYGQDKQINYLWLEWAWNLPADYDIYGKSSTGAWEFITSSQQEVATWATHVFDVNRTYRYLKLVTKGRIDKSSPIWLLELMAFEDVPNMYPKPAGTTMPNRSVNVLNNGNFSQGLDSWGTEAFDGANPTYNVQNGAAVIALTNDGGLSGSVQLHTSGFGLKRDYRYHISFDARADVARNLMVRLAENNLNPSAAGTYHVETVAVGTSFNTYSFTYDYTGQGEPARLAFLLGGMGTATTYIDNVVIREGDFIGSGEPLVAAISSTNFVSASNGWETEWWGAPARAVDGNLGNKASGNDGEAEGMDLDITVRIDEHYDVRAVLVAGDNSPERSLDQFRVEFGNGTPLMGWTDSTTEGVYEEFANFNNTPAAGERDFKFFFRPPAGQLVEVADVQLLAVDLMPHRISAIALDEGGTISPAGTTRYSRNNTDDATYTFTAPQGQSVSNVIVDGVSMGPLNSYTFTDINADHTLAVSFGGEVEQPETGDAINYAPEAYATASSELQTAALANDGDAGSRWESEHGAGPSWLALELNDTVRVSKVVIDWEAANAGTYEIQGSLNGIDWNTLEVVSGGAFGNRTDTVLLDGSASNSVNHIRIYGVERSAGNNWGYSIFNVEVWGEAGDTSMEEEVEIEPVSAAASSDFQAAANAIDADAGSRWESAHADATAHLTLDLASTYKLVSVAIDWEAANAGAYTLEGSSDGVNWTTIASFTGGAFGNRTDTLTVSGSHRFVRINCTEKSAGNNWGYSIYDVRLTALLPTP

SEQ ID NO: 162 - DNA, 3624 bp, Microbulbifer degradans
atgcaaccgtctgcgtacggtttgtattgtgctgcgtgttattcacaaaaatcaaagtgtgagtttatcatgattaaaaataacctaattaaatatgccgttagatgtgcagccttaggcgcactctctacaagtgcagtacatgttagtgctacagattacaacgacccatattggacaaaccccgaagtgaattctgactttgtggataatttcaaccaaacccaaattgaccgaagtaagtggttggttgaaacaaatatttttgtaaatggcgaagatatcgattatcaagatgtggagtacccacaagccgattggacaattggcgtagggcaggacgaccccgccgcaatagacggcaaggcgcttatattaaaagcgcgctacatggatggagaagtgcaagattactacggcggtgacccggcaaacccaggcaagccattgtttattcgttcggggcgtattgagtcgcaaataaccgacgatacaacttttacctatgggaaattcgaagcccgattaaaaatgccgcctgcacgcaacggcgaattccccgcgtggtggctattaggtaactttcctgatgtgggttggaccgcttgccaagagttagacattatggaatttaccggcaacaacggtatgaatattccacaaacctattggaccgccccctatgctgtacacggtggtacaacagtcggtttagcaggccttggtattactaatccgcaagagcagtatgttacttacggtattattaaaacgccgtcaaaagtagagtggtatatcaacggtgtgctcaccaatactttttctcgcgacaaccaaggtgacgatcaaccttggccgtacgtcacccccatgcgcatgattttaaaccacgcaattactcatgtggaatggccggatgtaggtaactacaacgcttattccccagatgccaacaggcccagcgccacaggttggagctatgtggataacaatggcgtaacccaatacgaatatattgatgtagatgcaatgaacgcaaatatcggtcgggcgggtaccgattttgttgtggattatgttgcccattggccgctacctactagcgatgccgaacacaaatatgtagacgatagtaaatccagctttttccgcgaatcgggtaacactaaaggcttttacaatttaaaaggctggttagcgccagtgtcagtgactgctgatggatttgatcaaccaggttgggataccgatgtgcgcgacaatggcgccgataatgcagctgatggctatgtaggctctaagtgggcaacacccaacgacgacggtattcattgggttgaagtggattacggccaagacaagcaaattaattacttgtggttagagtgggcgtggaacctacctgccgattacgatatatacggtaaaagcagtactggtgcttgggaatttatcacctcgtcacaacaagaagtggccacgtgggctacgcacgtttttgatgtaaatcgcacttaccgttacctaaagctcgtaacaaaaggccgcatagataaatctagccctatttggttgttagagcttatggcatttgaagatgtgccaaatatgtaccctaaacctgcgggtaccacaatgcctaaccgatccgttaacgtgctaaataatggcaatttttcgcaagggttagatagctggggaaccgaggcctttgatggcgcaaacccaacttacaacgtgcaaaatggtgcggcagtcattgcgcttacaaacgatggtggcttatcgggctctgtgcaattgcacacttcaggttttggtttaaagcgtgattatcgctatcacataagtttcgatgctcgcgccgatgttgcacgaaatttaatggtgcgcttagcagaaaacaaccttaacccaagcgcagctggcacctaccatgtagaaaccgttgctgtggggacaagctttaacacctatagttttacttacgattacacggggcaaggtgaacctgctcgactcgcatttttactgggcggaatgggtactgcgaccacctatatcgataatgtggttattcgtgaaggtgactttattggcagtggtgaaccgcttgtagcggctattagctctaccaactttgttagcgccagtaatggctgggaaaccgaatggtggggtgcgcctgctcgtgcggtagatggaaacttaggtaataaagcgagcggtaacgatggtgaagccgaaggcatggatcttgatattaccgtgcgtattgacgagcattacgacgttagagcggtattggttgcgggcgacaattcacctgagcgaagtttggatcagttccgcgttgagtttggcaatggcacacctttaatgggctggaccgacagcacaacagagggtgtatacgaagagttcgcaaactttaataacacgcctgctgctggcgagcgcgattttaaattcttcttccgcccacctgcagggcaactggtagaagtggccgatgtgcaattgctagcggtagatttaatgccccatagaatttcagccatagcgttagacgagggcggcactatttcgccagcaggcactacgcgctacagcagaaacaacaccgatgatgcaacctacacgtttaccgccccacaagggcaatcggtaagtaatgtgattgtggatggcgtgtcgatgggaccgttaaatagttatacttttaccgatatcaatgctgatcacaccttagcggtaagctttggtggtgaagttgagcaaccagaaactggcgatgctatcaactatgcgcccgaggcttacgcaactgcgagttccgagttacaaacggcggcgttagccaacgacggcgatgcaggttcgcgctgggagagtgagcacggtgcaggcccttcgtggttagcgctagagttaaatgacacagtgcgcgtatccaaagtggttattgattgggaagcggcaaacgctggcacctatgaaattcaaggctcgctaaacggtatagattggaacaccttagaagtcgttagtggtggagcctttggtaatcgtacggatacggttttactagatggctctgctagtaattctgtcaaccatattcgtatatacggtgtagaacgcagtgctggcaacaactgggggtattcaatctttaacgttgaagtatggggcgaagcaggtgatacctcgatggaggaggaagtagaaattgagcctgtatccgcagcagctagcagtgattttcaagcggcagcgaatgcaatagatgccgatgctggtagtcgctgggaaagcgcgcacgcagatgctaccgcacacttaacattggatttagcatcaacctataaactcgtgtcagtcgctatagattgggaagctgccaatgctggagcttacaccctagaaggttctagcgatggtgtaaattggacaaccattgcaagcttcaccggcggtgctttcggcaatagaaccgatactttaacggtgagtggcagccatagatttgtacgcattaactgtacagaaaaaagtgcaggcaacaattggggctattccatttatgacgtacgtctaactgcattattacctacgccttaa

SEQ ID NO: 163 - protein, 331 aa, Microbulbifer degradans
  MOD_RES (313)..(329): Variable amino acid
MKKVFSLIIGLSLSLPVWAGWERQWIDTFDGDSVDWTNWTAQVEANYNNEVQCYTADETSANKNYDVSDGTLKIIARKQSVECAGLGGQNKTWTSGRLNSKDKQEFLYGRIESRIRFHNLEGGTWPAFWMLENRISETPRKYDDDYEQWPNPGAGEIDVWEWFSNGPNIYIINFFNANNCGDRHDYVYPNGGSDVLNWHNYAMEWDANNISFFIDGSLITSFDVSSCPQYKEKMFVLLNLAVGGNLGGTIDPNLSLATLEVDYVGYCTATNANDYASCDETTPAALQGEPSTSWVLSTVNATATLANAAQNSXXXXXXXXXXXXXXXXXKL

SEQ ID NO: 164 - protein, 707 aa, Microbulbifer degradans
  MOD_RES (14)..(30): Variable amino acid
MLPPRLPMQRKIAXXXXXXXXXXXXXXXXXNYNNEVQCYTADETSANKNYDVSDGTLKIIARKQSVECAGLGGQNKTWTSGRLNSKDKQEFLYGRIESRIRFHNLEGGTWPAFWMLENRISETPRKYDDDYEQWPNPGAGEIDVWEWFSNGPNIYIINFFNANNCGDRHDYVYPNGGSDVLNWHNYAMEWDANNISFFIDGSLITSFDVSSCPQYKEKMFVLLNLAVGGNLGGTIDPNLSLATLEVDYVGYCTATNANDYASCDETTPAALQGEPSTSWVLSTVNATATLANAAQNSGAIAFETSAFGENASDPMIYQAGQNITAGKEYTLAFDVRSNTAGRAFRAFVAASAEASQGILDQEVVVANADAWQFVSLNFTSEQTFNDAVIAFQSGTAALGNGELLFKNIVLTEHSTLYSTTVVTNAGGSINPPGPTVKTVSGYSSHFTITANVTHAIGDVFIDGVSVGPVAEYTFDNIQGDHEIEVQFVALPPPEGTEILTPVAATASSSLSVASRAIDGDYATRWESRHGIEATWLELDLGTAVDLHSILINWEAANAKAYTLEGSNDGENWTVLASVTNGTFGDRADELSLTGSYSHLRINATERSAGNDWGYSIWDIVLYAYTQDQNASSSSSSSSNSTTSSSSSSSTSSSSSSSSSSSSSSSSSSGGSEPASSGSGRMDGVVFLFLMVLFGLVTQRVVLAKLVS

SEQ ID NO: 165 - DNA, 2124 bp, Microbulbifer degradans
  modified_base (40)..(89): a, c, g, or t
atgctaccgccacgcttgccaatgcagcgcaaaatagcgnnnnnnnnnnnnnnnnnnnnnnnnnnnnnnnnnnnnnnnnnnnnnnnnnnaaattataacaacgaagtgcagtgttataccgcagatgaaacatccgctaataaaaactacgacgtatctgacggtacgctaaaaataatagcaagaaagcaatccgtcgagtgtgcaggcctaggtggccaaaacaaaacatggacatcagggcgattaaacagcaaagataaacaagagttcttgtatggccgtatagaatcccgcattcgcttccacaacctagagggcggcacgtggccggcattttggatgctcgaaaaccgcatatccgaaaccccgcgtaaatacgatgatgattacgagcaatggcccaaccccggtgccggtgaaatagatgtgtgggagtggttttcgaacggccctaatatttacatcataaacttctttaatgctaataactgcggcgataggcacgattacgtttacccaaatggcggcagtgatgtactaaattggcataactatgccatggagtgggatgcaaataacattagcttttttatagatggcagcctgattacctcgtttgatgtgtcttcgtgcccgcagtacaaagagaaaatgtttgtactactcaacttggccgttggcgggaatctaggtggtactatcgaccccaatttatcgctcgcaacattagaagtggattacgtaggctactgcacagctaccaatgctaacgactacgcaagctgtgatgaaacaacacccgctgcattgcaaggtgagcccagcacatcgtgggtgttaagcacagtaaatgctaccgccacgcttgccaatgcagcgcaaaatagcggagccattgcgtttgaaacaagcgctttcggcgaaaatgcatcagaccctatgatttaccaagcagggcaaaacatcacagccggtaaagaatataccttagcgtttgatgtgcgatccaatactgccggccgcgcctttcgtgcatttgtggcggctagtgccgaagcctcgcagggtatattagatcaagaagttgtggttgcaaatgcagacgcatggcaattcgtaagtttaaacttcacgtcagaacaaacctttaacgatgcggttatagcgtttcaatccggcactgcagcactgggtaacggtgagttgttgtttaaaaatatagtgcttaccgagcattccaccttgtactcaacaacggttgttaccaatgctggtggttcaataaaccctcctgggcctacagtaaaaaccgtaagcggttacagtagccactttacaattactgcaaatgtaacccatgctattggcgatgtgtttatcgatggcgtaagcgttggccctgttgccgaatatacgttcgacaatatacaaggcgaccacgaaatagaagtgcagtttgttgcactgccgccccccgaaggtaccgagatacttacccctgtagccgccactgcgagcagttcacttagtgttgcgagcagagcaatcgatggcgactacgcaacccgctgggaatcgcgccacggtatagaggctacgtggctagagttagatttaggcacagccgtagatttgcactccatactcataaactgggaagccgcaaacgcaaaagcgtacaccctagaaggctctaacgatggcgaaaattggacagtactcgcaagcgtaacgaatggcacctttggcgaccgcgccgatgagctatcactcactggcagctactcacacctgcgaataaacgcaaccgaaagaagcgcgggtaatgattggggctattccatttgggatatagtgctatacgcatacacgcaagatcaaaacgcaagtagcagctcgtctagttcttcaaacagtacaacctctagttcttctagctcatccacttcttcgagtagctcttcctcaagctcttctagttcatcttcaagttctagctctggcggcagtgaacctgcttcgagcggtagcggcagaatggatggtgttgtttttcttttcttgatggtgttgtttggtttggttacacaacgcgtcgtgttagctaaattagttagttaa

SEQ ID NO: 166 - protein, 573 aa, Microbulbifer degradans
MEATMIKTCKTTPAKWAAALSLGCALLLPSGVNAATFQAEDYSAFYDTTAGNTGGAYRNDNVDIEATNDNGGGYNVGWIDANEWLVYPGVNITTTGDYVINVRVASASGGALSVDFNAGSIPLGQFDIPNTGGWQNWVTVSKTVTLTAGTYDMGVFASTGGWNFNWIEVTPVNNGGGNGGGSATFFQAEDYSNYSDTTPENIGGAYRNDGVDIETTSDANGGHNIGWMENGEWLAYEGLSIPSNGNYIIKARVASPNGGALSFDLNGGGQVLGTMNIPATGGWQNWQTVELSTNINAGTYTLGAFVSTSGFNLNWIEVVAGGDGGNNGGGGGNITWRDEFDTINRDVWNFETGGGGWGNNELQYYTDGQNASIQFDPQAGSNVLVIEARKETGGQCWWGGNCGYTSSRMNTRFKKSFQYGRIEARMKLPRTQGIWPAFWMLGDNFNNVGWPQGGELDIMEHVGTNNITSGALHGPGYSGNTPITGHLEHGASIDSGYRVYAVEWDTNGIRWFVDGTNFYSVEKWQVQQYGEWVYDQPFWILLNLAVGGNWPGDPDHANFTTQRFYIDYVRVIQ

SEQ ID NO: 167 - DNA, 1722 bp, Microbulbifer degradans
atggaggctacaatgataaaaacatgcaaaaccacaccagccaagtgggcagcagcccttagcttaggctgcgccctacttttaccctcaggcgtcaatgctgccaccttccaagcagaagattacagcgccttctacgacaccaccgcgggtaacactggcggcgcctaccgcaatgataacgtcgatatagaagccaccaatgataacggcggcggctataacgtgggctggatagatgccaacgaatggctggtatacccaggcgtaaatatcaccaccaccggcgactatgtaattaatgtacgcgtggcgagcgcaagcggcggtgcactttctgtcgactttaatgcaggctctattccactgggtcagttcgatattcccaacactggcggttggcaaaactgggtaaccgtttcaaaaacagttactttaactgccggcacctacgatatgggcgtattcgcctctaccggcggctggaactttaactggatagaagtcacacccgttaataacggtggtggcaatggcggcggttcagccacgttctttcaagcggaagactacagcaactactccgacaccacacccgaaaacattggcggcgcctatcgcaatgacggtgtagatatagaaaccacaagcgatgccaacggcggccacaatataggctggatggaaaacggcgaatggcttgcctacgaaggtttatctattcccagtaacggcaactacatcattaaagcgcgtgtagctagccccaacggcggcgcactatcgtttgatttaaacggcggcggccaagtgcttggcacaatgaacatacccgctactggcggttggcaaaattggcaaaccgtagaattgagcaccaacattaatgccggaacctatacgctcggcgcctttgttagtactagtggctttaacctaaattggatagaagtcgttgccggtggcgacggcggcaataatggtggcggtggtggcaacatcacttggcgcgatgaattcgacacaatcaaccgcgatgtttggaattttgaaaccggtggcggcggctggggtaacaacgaattgcaatactacaccgacggccaaaacgcttccattcagttcgacccgcaagccggtagtaatgtgttagttatcgaagcccgcaaagaaaccggtggccaatgttggtggggcggcaattgcggttacacctctagccgcatgaacacgcggtttaaaaaatcgttccaatacggccgtatagaagcacgtatgaagctgccgcgtacccaaggtatttggccagcgttttggatgctaggtgacaactttaataatgtaggctggcctcaaggtggcgaactagacattatggagcacgtaggcaccaacaatatcacatcgggtgcattgcacggcccaggctacagcggtaatacgcccattaccggccatttggagcacggtgcaagcattgattctggctaccgtgtttacgcagtagaatgggataccaatggtattcgctggtttgttgacggcaccaacttctacagcgtagaaaaatggcaagtgcaacagtacggcgaatgggtttacgaccaacctttctggatactgctaaacctagcggtgggaggcaactggcccggcgacccagaccacgccaactttactacccaacgtttttacattgactatgtgcgggtgattcagtaa

SEQ ID NO: 168 - protein, 742 aa, Microbulbifer degradans
MKKLKLLELSLVVLVALGLASCGGSDDKKTPDPVEEPVGEPESEPESEPESEPESEPEPENAWQLLWEDNFDSEISASNWGFEVNCTGGGNNEKQCYTDRADNAYVDEAGILHIVAKEEAFSGPAIQDDDPNYNPDDTSAARNYTSARLRTLDKFDFKYGRVEIRAQIPGGQGSWPALWMLPSDKVYGGWPASGEIDIMEAVNLDTDAANAVHGTLHYGLQWPQWSTIGASYETNDDFTGEFHTYAIEWEADQIRWFVDGVHTQTQVSDNWYNFVWGGQESGFAVANPRAPYDQEFHLIMNVAIGGNWPGDPDTGWASDREMLVDYVRVYQCDSEADDGTGCANATDAVDIAISPTADVGAPSQVEYDLYSDGLQTPAFTNAGVTLAANVWQETEGNVVTTTGNLGDDHGDAWEITFNGTGNVSIAIAEQDGVESYVRLNGGTAWSNYGVLAFDMYVDSVDAETGFVVKMDSVYPNVGAVDIATPAAGEWTRVHVKVADILANPIAGGGGLNVAQAVNLFVLEPTGTKTAHVYVDNISISCAYNSTAKSWQGDKTCDVAAVPTADTSGIDLSGNELVIFDEQEPDFWGFGQFSAGGAEVAMSFLADPEDASHGNVLGFSYPDSQNVAYLQSATPLNLSDWAGGTIQFDMYVISEPANVNWMMKVDCVHPCSSGDIPLTTNIDGVVPAVGVWQTYRFNLDALVAGNPGLDLTKVDTPLVIFPAWDNQTGANFRIDNIKFVRAN

SEQ ID NO: 169 - DNA, 2229 bp, Microbulbifer degradans
atgaaaaaactaaagcttctagaactttcgctggtggtgttggtagccctagggctagcgagctgcggcggttctgacgacaaaaaaacgccagacccagtagaagaacccgtgggtgaaccagaatcagagcctgaatcagagccagaatctgaacccgaatctgagccagaaccagaaaacgcatggcaattgctgtgggaagataatttcgacagcgaaataagcgcatctaactggggcttcgaagttaactgcaccggcgggggtaacaacgagaaacagtgttataccgatagagccgacaacgcttatgtagatgaggcaggcatactgcacatagttgccaaagaggaagcatttagcggacccgctattcaggatgatgaccccaactacaaccccgatgacacatcggctgcgcgcaattatacctctgcgcgtttgcgtacattagataagtttgacttcaaatatggtcgagtcgaaattcgtgcgcaaataccaggtgggcagggctcatggcctgcattgtggatgttgccaagtgacaaagtatatggtggttggccagccagtggcgaaatcgacattatggaagcggttaatttagatactgatgcggccaatgccgtgcatggtactttgcactacggtttacagtggccacaatggtcgacgataggcgcttcttacgaaacaaatgatgatttcaccggtgagttccacacttatgccattgagtgggaagcagaccaaattcgctggtttgtggatggcgtacacactcaaacacaggtgtccgataactggtacaactttgtatggggcgggcaagagtccggctttgctgtggctaacccgcgtgcaccttacgatcaagagtttcatttaatcatgaacgtcgctataggcggcaactggccgggtgacccggacacgggttgggcatctgatcgcgaaatgcttgtagattatgtgcgtgtgtaccagtgtgattctgaagccgatgatggaacaggctgtgcaaacgcaaccgacgccgttgatattgctatttcaccgaccgcagatgtaggtgcgccatcacaagtagaatacgacctatatagtgacggtttacaaacgcctgcatttaccaacgccggcgtaactcttgctgcaaatgtttggcaagaaacagaaggcaacgtagtaactaccactggcaacttgggcgacgaccatggcgatgcttgggaaattacctttaatggtactggtaatgtatctattgctattgccgagcaagacggcgtggaaagctatgtgcgattaaatggcggaacagcttggagtaactacggcgtactagcgtttgatatgtatgtagatagcgtggatgccgaaactggctttgttgttaaaatggacagtgtttaccccaatgtaggtgctgtagatattgctacacctgccgcaggtgagtggacgcgagtgcacgtaaaagtggctgatattttagctaacccaattgcaggtggcggtggccttaacgttgcgcaagcggttaacttgtttgtacttgagccaacaggtactaaaacagcacatgtatatgtagataatatttctattagctgcgcatataactctactgcaaaatcttggcagggtgataaaacctgtgatgttgcagcggtgcctactgccgatacctcaggtatagatttaagtggtaacgagcttgtgatttttgatgagcaagagccggatttttggggttttgggcagttttctgctggtggtgctgaagtagcaatgagcttcttagctgacccagaagatgcgagtcacggtaatgtgttgggctttagctacccagatagccaaaacgttgcctacttacaatctgctacaccgcttaatttaagcgattgggctgggggtactatccaattcgacatgtacgttattagcgagcctgctaatgtaaattggatgatgaaagtggattgtgtacacccttgttcatctggcgatataccgctcaccaccaatattgatggtgtagtgcctgctgtgggtgtatggcaaacctatcgctttaacttagatgcattagttgctggcaacccagggttagatttgaccaaagtggatacgccgctagtaatattccctgcatgggataaccaaaccggtgctaacttccgtatagataacattaaatttgttcgggctaactag

SEQ ID NO: 170 - protein, 881 aa, Microbulbifer degradans
MGLTMVKNKLYLALSIAAATSLTACGGGGDAADDTVKRNVFAVGDVFKTQEDGDAVEADVSENDFGRGLTFALESGSTTANGELVFNADGSFTYTPNADFSGKDSFTYVATHTASGDTASALVTINVISDFETIEESGWTLTWSDEFDSLDSMAWDAMNASASEGVLSVSAVEGQTSYVKSTAALGQAGRIEASIQLPDGKSLYSGFGLMPMADMFDGKNALMAIESANNKATAGGHWGIGLVNGVEINEPTNAVVRAEFHTYAIEWNESLIRWYIDDIHIHTVDTLNTWSYNLSGDTVVADTTTKPFSQDLQIMMELTAASSGLPNAMLVDFVKVYECDTSVTDQIESCAFAADENVDKLASNRIESVGEIVTPLFTDELTSLSWHYSDAEEAVTFVTEQESAVPTHRGIVSQPDVMEPVAEVAPVDPVEEGEEGYEEYQAYLAYVDYLNYLETLAFLDTVDPSRERGAVIRYQSDASTWSNFSLNTPSLGLVGKDSALQFDMYIDSASTTTETIEIRMETGWPFLGTVLLNVADLQLDTWVTYNIPVSDFLANPFITPDWAVGQDWFLGGNGVEGQPLYLDTNSITKAIVVQLAAPGHLVFDNVAITCVSNESCFQGPLAKQPIVKAGPAPIIYEAEAYTAVTGEVQTEDTQDAGGGQNVGYIDAGEALEYTIVAPIDGTYKFQYRLASGLESASEFDVSIDDMLIDGQSLPGTGGWQVWTTLESGEFDLTAGEHAIVFNFAGGMNFNWFAIVPPPIAIFIEAEDYSSMAGVQLEDTADEGGGQNVGYIDAGDFLQYNVEVPADGTYFIELRVASSGGSDGFTITSNGITTSTIPVADTGGWQNWTTQTVEMQLSAGQQTLRFDFIGGAINFNWINVTN

SEQ ID NO: 171 - DNA, 2646 bp, Microbulbifer degradans
atggggttaacaatggttaagaataaattgtatctagcgctatctatagcggctgctacaagcctaacggcatgtggtggtggcggggatgcggctgatgacactgttaaacgcaacgtatttgccgtaggcgatgtgtttaaaacgcaagaagatggcgatgcggttgaggcggatgtaagtgaaaacgattttggcagaggcctcacgttcgcattagaaagcggtagcaccacggctaatggcgagctggtattcaatgccgatggctcttttacgtatacacccaatgcggacttctctggtaaagactcctttacctatgtggccacccacaccgcatcgggcgatacagccagtgccttggtgactattaacgtaataagtgactttgaaaccatcgaggaatctgggtggacgctaacgtggtccgacgaattcgatagtttagatagcatggcgtgggatgcgatgaacgcatctgcttctgaaggtgtgttgtcggtaagcgctgtagaagggcaaacatcttacgttaaaagcaccgctgcactggggcaggctgggcgtattgaggcgagcattcagttgcccgatggtaaaagcttgtactctggctttggcttaatgccaatggccgacatgttcgatggtaaaaatgcattaatggccatcgagagcgcgaacaataaggcaactgctggtggtcattggggtattggattagtaaatggtgttgaaattaatgaacccactaacgcagtagtacgtgcggaatttcatacctatgccatagagtggaatgagagtctgattcgctggtatatagatgatatacatattcataccgtagatacccttaatacctggtcatacaatttaagcggcgataccgtggttgccgatactaccactaagccgtttagccaagacctgcaaataatgatggagttaacggcagcaagttcaggtttgccaaatgcaatgctggtagattttgtaaaggtttatgagtgtgacacgtctgttaccgatcaaatagaaagctgcgcattcgcggctgacgaaaatgtggataagcttgcttccaaccgtattgagtcggttggtgaaattgttaccccattgttcacagatgagcttacatcgttaagctggcattactctgatgccgaagaagctgttacttttgttacagagcaagaaagcgctgtgcctactcatagaggtattgtttctcagcccgacgttatggagcctgtagcagaagttgcaccagtggaccctgtagaagaaggtgaagagggctacgaggaatatcaagcttacttagcttatgtggactacctgaactatttagaaactctcgcatttttagatacagtggacccaagccgcgaacgtggcgctgttattcggtatcaatcggatgcaagcacatggtctaattttagtttgaatactccgagcttaggcttagttggaaaagattccgcgctgcagtttgatatgtatatcgatagcgcatctacaactaccgaaaccatcgaaatacgcatggaaaccggttggccattccttggcactgttctgctaaacgttgcagacttgcagctagatacttgggtgacgtacaacattcccgttagcgactttttagccaatccatttattacacccgattgggcagtgggccaagactggttcttgggcggtaacggtgttgaagggcagcctctctatttagataccaattcaattactaaagccattgtggttcagctagcagcaccagggcatttagttttcgataacgttgcaattacttgtgtttcgaatgaaagctgcttccaggggccattagccaaacagcccatcgtaaaggccggtcctgctcccattatttacgaagcagaagcttacacggcggtaacgggtgaagtgcaaacggaagatacccaagacgcgggcggcggccaaaacgttggctatatcgacgcaggtgaagcattggaatacaccattgttgcacctatcgacggtacctataaattccaatatcgcttggcaagtggcttagaaagcgcttctgagtttgatgtttctatcgacgatatgcttatcgatggccaaagcctacctggtactggtggctggcaagtgtggaccacattggagtctggtgagtttgatctaactgctggtgaacacgctattgtgtttaattttgctggcggtatgaactttaactggtttgcaattgttccgccccctattgcgatttttatcgaagctgaagattactcgtcaatggctggtgttcagcttgaagacaccgcagatgaaggcggcggtcaaaatgttgggtatatcgacgcaggtgatttccttcaatacaacgtcgaagtgccggctgatggtacctacttcattgaattgcgtgtagccagcagtggtggtagcgatggctttaccattacttccaatggcattactacaagcactattcctgtagcggataccggtggttggcaaaattggactactcaaactgtagagatgcaattgtctgctggtcaacaaacacttcgtttcgactttatcggtggggccattaactttaactggatcaatgtcaccaactaa

SEQ ID NO: 172 - protein, 1186 aa, Microbulbifer degradans
MILRLIRAAIYIVAFVSLIACGGSSTSKPAQPDIPDTDLPDTGTPEPENSDPVVQSTPATAIAAGNVYSYQIMASDADESDVISYAAVTLPSWLAFDPDTGILTGTPQQAHAGNAEVVLSYSDGNVTLQQQFTIAVSASYTEEPPTPMSRPTVNAADTSTYTITAYGAGSIADAINPASYGCVYDYGNWIYNAGVVEPGVSGCDPIGAPTYRTPQVVGEAASVPTPTHKWWGSVSFLGEMKIGDPAGAGYITPDPITARISNKGVRIMGIPNGLGAQGNQFIYSVPDPFSEVFDGIAVANSEYANLEAYLKSYSDGTATVQWQSGNLPVMQATFVHGSPYVFFKAYRGNMVLRTKAADGGEKGTFYNENNSLGIWTSVAGNKNDFLITGEGETVFNNIETDTITLTNAANEFTLTLLPTAGAGTPSSTVIQAFEDSARAVVAKVDIQYSVDRTNNMVTVTHTYKNESNTPVQTLAGLLPMHWKYSDTALSGYKTRSARGMVQFAHIDSFSYTIPYVGVLPYLPSSVGDFDSSVLAGLVQAFVAEGPENWNPHTDTYWSGKAFNKVAELSAIARSVGMTSEADTLLNWLKAELQDWFSANTNGSLDEKKYFVYDAEWNTLLGLEESFAAHQQLNDHHFHYGYFVRAAAEICRVDASWCGADQYGPMVELLIRDYAGAKDDTMFPYVRNFDPANGFSWASGSANFVLGNNNESTSEAANAYGAIILYGLITGDNELVERGMYLHASSSVAYWEYWNNIDRYLGADADRDNFPSGYDKLTTSIIWGHGGVFSTWFSGAYAHILGIQGLPTNPLIFHVGLHPEYMEDYVALGLSESSNNKPSGLIDDQWRDIWWNLWALTDAEAAIADYNTVGSNYAPEFGETKAHTYHWLHTWNALGHLKTGTGELTVNDPAALVFEKDGIKTYVAYNFSGTPKTILASDGFEFIAQPNDFTVVTTADNNPDDTQPPTLPANLQALNLTQTSLDVKWDASTDNYRMAGYVVQVLQADTLIEETSSIASIASFNNLTASTSYTIQVKAKDRSGNETAWVSITVTTPSETDDLLPTLDGGVYSANVGPNSADLSWAAATDDRGIASYTIEVQVGGAVFVTETVFDTSYALSGLTEATEYNVAVYATDTGGQQSATISGIVNTTSNPFGSGCELICASATSSSSVTFTVHQAGAVDIHYLVN

SEQ ID NO: 173 - DNA, 3558 bp, Microbulbifer degradans
atgatactgcgactgatacgtgccgcaatttacattgtggcgtttgtttctcttatcgcctgtgggggctcaagcacatccaagcccgcgcaaccggatattcccgatacggatctgcctgacacgggaacacccgaacccgaaaacagcgatccagttgttcaatctacgccggctacagccattgcggcgggcaacgtgtatagctatcaaataatggctagcgacgcagacgaatcggatgtcattagctatgcggcggttactttgcctagctggctggcgttcgacccagataccggaatacttaccggcacgccccagcaagctcatgctggtaatgctgaagtggtgcttagctatagtgacggcaacgtaaccctgcagcagcaatttacaattgcagttagcgcgagctacaccgaagagccaccaacaccgatgagtcgcccaaccgtaaatgcggcggataccagtacttacactattactgcctacggcgcgggcagtattgcggatgcgattaaccctgctagctatggctgtgtgtacgattacggtaattggatttataacgccggcgttgtggagccaggagtaagcggctgtgaccctataggcgcaccaacctaccgtacaccgcaggtggttggggaagcggcaagcgtgccaaccccaacgcataaatggtggggctcggtttcttttttaggtgaaatgaaaataggtgacccggcaggcgcaggttacataacgccagacccaataactgcacgtatctcgaataaaggcgtgcgtattatgggcatacccaacggcttgggcgcgcaaggcaaccagtttatttactctgtacccgacccttttagcgaggtattcgatggaatagcggtagcgaatagcgaatatgccaacctagaagcgtatttaaaatcctacagcgatggcaccgctaccgtgcaatggcagagtggcaacctgccggttatgcaggccacatttgtacacggctccccctatgtgttttttaaagcctatcgcggcaacatggtgttgcgcaccaaagctgcagacggcggtgaaaaaggcacgttttataatgaaaataatagtttaggtatttggaccagtgtagcgggtaacaaaaatgactttttaattaccggtgaaggcgaaacggtttttaacaatatcgaaaccgataccattacgttaaccaatgcagcgaacgaatttaccttaacgttattacctacagcgggcgccggtacaccttcaagtactgttattcaggcgtttgaagatagcgcccgtgcagtggttgccaaagtagatattcaatactcggtagaccgtaccaataacatggtaacggttactcatacctataaaaatgaaagcaatacgccagtgcaaaccctcgcggggttactgcccatgcattggaagtattccgatacagcattaagcggctacaaaacccgaagtgcgcgcgggatggtgcaatttgcccatattgattcgtttagctacaccattccttatgtgggagtattaccgtatttaccgtcatcggtaggggatttcgattcctctgtgctcgcaggcttagtgcaggcgtttgtagctgaagggccagaaaattggaacccgcacaccgatacctattggtcgggcaaagcgtttaataaagttgccgagttatcggcaatagcgcgctcggtaggtatgacaagcgaagcagatacgctgttaaattggcttaaagccgaactgcaagattggtttagcgccaacaccaacggcagtttggatgagaaaaaatactttgtgtacgatgccgagtggaataccttgcttggcctagaagaatcttttgctgcacaccaacaactaaacgatcaccactttcactacggctattttgtacgcgccgctgcagaaatatgccgagtagatgcaagctggtgtggcgcagaccagtatggtcccatggtggaactgcttattcgcgattacgccggtgccaaagacgatactatgttcccttacgtgcgtaacttcgaccccgccaatggcttttcttgggcatcgggtagtgccaactttgtgctgggtaacaacaacgaatccacatccgaagcggccaatgcctatggtgcaattattctgtacgggttaataactggcgataatgagttagtggagcgcggtatgtatttgcacgcgtcttcgtcggtggcctactgggaatattggaacaacatcgaccgctacttgggggccgatgccgaccgcgataattttccatcgggttacgacaaactaactacctctattatttgggggcatggcggcgtgttctctacctggttcagtggcgcttacgctcatattcttggtattcaagggctgcctaccaacccgcttatttttcatgtgggcttacaccccgagtatatggaagactatgtggcactgggtttaagtgaatcgagcaacaataaaccttcggggttaatcgacgatcagtggcgcgatatttggtggaacctatgggccttgactgatgcagaagcggccatcgccgattacaacacggtaggcagtaactatgcgccagagtttggtgaaaccaaggcgcacacctaccactggttgcacacgtggaatgcgctcggccatttaaaaaccggcactggcgagctaacggtaaacgaccccgctgcattagtgtttgaaaaggacggaataaaaacctacgtagcgtataactttagcggtacaccaaaaactattttggctagcgatggctttgagtttattgcgcagcccaatgattttaccgtggtgaccaccgccgataacaaccccgacgacacgcaaccgcctacactaccggcaaacttgcaagcgcttaaccttacccaaacgagcttggatgttaaatgggatgcatctaccgataactaccgtatggcaggttatgtagtgcaggtattacaagccgatacattaatagaagaaacgtcttctatagccagcatcgcctcgtttaataacttaacggccagcacaagttacaccattcaagttaaagctaaggatcgctctggcaatgaaaccgcatgggtaagcattacggtaaccacgcccagcgaaaccgacgatttactaccaacacttgatggcggtgtatatagcgcaaacgtggggcctaactctgcggatttaagctgggcggcagcaacagatgatcgcggtatagcaagttacaccatagaggtgcaggttggcggcgcagtatttgtaactgaaacagtgtttgatacttcgtatgcgcttagcggattgaccgaagcaaccgaatacaatgtggcggtttatgctacagataccggcggtcaacaatctgccactattagcggtattgttaataccaccagcaatccatttggcagcggttgcgaattgatttgtgccagcgctacctctagctcatctgttacgtttactgtgcatcaagcgggcgcggtagatattcactacttagtgaac

SEQ ID NO: 174 - protein, 371 aa, Microbulbifer degradans
MGSSFLTCYKPSKEVITVKRAAINLVLIPGLAVSMGTLSSSAFAQSTCSVDYRVESDWGAGATHKVLVTNTGAPINGWQMSWTFSGNEQITNLWNGMFTQSSQSVIVDSLSWNAQLNTGATAEVGFNINSPSGQLPDVYLNGVNCSNPGEPEPEPEPEPEPEPEPEPEPEPEPEPEPEPEPEPEPEPEPEPEPEPEPELAYSLDATASFLNFVSSKKTHVLETHRFDVLSGGISTAGEAQLVIDLNSVNTGIDVRNGRMRDYLFETATYSVATVTVPVDLAAVAGLAVGEDMLVDVSATLDLHGVPGVIDTQLNVQRLSATRIMVQNQSPLLIKAADYSLEAGIETLRNLASLNVISTTVPVDFVLFYEAP

SEQ ID NO: 175 - DNA, 1116 bp, Microbulbifer degradans
atgggaagcagttttctcacctgttataaacctagcaaagaggtaataaccgtgaagcgagcagcaataaacttggtgctgatacccgggctagccgtaagtatggggacgttgtcgtcttctgcttttgcacaaagcacttgtagtgtggactatcgagtagagtccgactggggtgcaggggctacgcacaaagtattagttactaacactggagcccccataaacgggtggcaaatgtcatggactttttctggcaacgagcaaatcactaacctttggaatggcatgttcacccaaagctctcaaagtgtgattgttgatagtctgtcgtggaatgcccagctaaataccggtgccaccgcagaagtggggtttaatattaactctccttcagggcagttgccggatgtgtatttgaacggcgtaaattgtagtaaccctggtgagccagagccagagccagagccagagccagagccagagccagagccagagccagagccagaacctgagcctgagccagaacctgagccagaacctgagccagaacctgagccagaacctgagccagagccagagccagagccagaattggcctattcattagatgcgactgcatctttcttaaactttgttagctcaaagaaaactcacgttcttgaaacacaccgttttgacgtgctttctggcggtattagtactgcgggtgaggcacaacttgttatcgatcttaacagtgtgaacacaggtatagacgtgcgcaacggacgtatgcgcgattacctgtttgagactgcaacctattctgtagcaaccgtgactgtgcctgtagatctagccgcagtagcaggtttagccgtgggcgaagatatgctggtggatgtatccgcaactttggatcttcacggtgtgccaggcgttatcgatacgcagctaaatgtacagcgcttatcggcaactcgcattatggttcagaaccaatctccactattaataaaggcagccgattattcgcttgaggcgggtatcgagacattgcgtaatctcgcgagcctaaatgttattagcaccacggtgccagtggattttgttttgttctacgaagcgccttaa

SEQ ID NO: 176 - protein, 1042 aa, Microbulbifer degradans
MKKIFKISALSLGFSIAGAASAADLCNVTYEAVNSWGSGAQQAVTVVNNGPALNAWQLSWTFNGSENIDNLWDGVLSQTGANVTVNNAGYNGSVGTGGQFSFGFTVSGWSENFPTEFYLNGEACSGAVDPNPNPNPEPTDGAVWELNSADSVFSFVTVKKEHVAEVQTFTAYNATVDSDGVATLAIDLNSAETNIDIRNERFRNVLFETAFLPTLYYSVQLDMASLSALAVGDAQTQTLGGTLTLHGVQAVVEAEVLVVKTSATDLTVSTSKPILIKAADFDLVSGVESLRALASLSSIGQTVPVYFRLDFDAADPQVTNAVAVPATPAAPTSLTADFTESSGIAALNWNDASNNETEFLVRRREASTGYWSRLTEVNANSTLLDDLLLEEDTYDYKVIALNNGVPSAPSPVATVVATTNPNPEPLTGEEHYQAKCASCHGDDASGGVVGVALNTERDLTVMLNTIVTRMPPGEADNCDQECAEAIGGYIQTTFWNGGEPEPELACDTVTYGARQLKLLTKAEYQRSVEDLVGIDYNVASGLAEDNIIGYFVNNTTKVVVPTVYDQYLTVAEEIAQWSADRNFAGALTCGTNFNQTCANQFVNNFAPKVFRRALSSDEAAAYLAIANGSATNGDVKAGIQLAMEGLFSSPQFVYRHELGEANPNNNAIDSDAFELTSYEMATWLSYTYAGTTPDAIAMQKAANNQLRTDAEIRAEAQRLLEGAGAKQKMGDFVASWLGTDHIANAPKDASVWPGFDALIPHLQTEIREMFSYVMLEPTESFASVYNANYTFVNGPLAQHYGINGVSGNEFQKVTTTDRGGILANGAFMARWGESVESSPIRRSVRVRRRMLCQDQPDPPGNVNIGRENAADEFHEALADPTTTNRERYELLTSGETCATCHQEWINPLGFGMEDFTAVGTRRVTDLNGNTIDASGQLYAPENLNDKDVFINFNGTQGLGALLTTLPSAQSCLPQNLFRYSVGVGVEGLDDNPEGNELVPAERDGYACEVKNLTSTMLEQSPRAMLEGMGSMQAVRYRKAWAR

SEQ ID NO: 177 - DNA, 3129 bp, Microbulbifer degradans
atgaaaaaaatattcaagatttcagcgctctcgctaggtttctcaattgctggcgctgcatctgcagctgatttgtgcaatgtaacctacgaagcggtaaatagctggggctccggtgcccagcaagcggtaaccgttgtaaataacggccctgctttaaatgcctggcagttaagctggacatttaacggcagcgaaaatatagacaacctatgggatggcgtgctttcgcaaactggtgcgaatgttaccgttaacaatgctggctataacggcagtgttggtactggcggtcaatttagcttcggttttaccgtaagcggttggagcgaaaactttcccacagagttttacctaaatggtgaagcgtgtagtggagctgttgaccctaatcccaatcctaacccagagccaactgatggcgctgtgtgggagttaaactcagccgattcagtgtttagctttgtaactgttaaaaaagagcacgttgccgaagttcaaacgtttactgcctacaacgcaacagttgatagcgatggcgttgcaacgcttgctatagacttaaacagtgcagaaacgaacattgatatacgcaacgagcgcttccgcaatgtattgtttgaaacagctttccttcctactctgtactacagtgttcagctagatatggcttcactgtctgcattggcggttggcgatgctcaaacgcaaacgcttggtggcacgctaacactacacggtgtacaagcagtggttgaggctgaagtgttggttgttaaaactagcgctaccgacttaaccgtatcaacgtctaagcctattttaattaaggctgccgattttgatttggtaagcggtgtagagtctttgcgagccttggctagtctttcaagtattggtcagacggtacctgtttacttccgtttagacttcgatgctgcagacccgcaagtaactaatgcggttgctgttcctgctactcctgcggcgccaacgtctctaactgcagacttcacagaaagcagtggtattgccgcgttgaactggaatgatgcaagcaataacgaaaccgagtttttggttcgtcgtcgtgaagcgtcaaccggttactggtcaagactgaccgaagttaacgcgaacagtactttgttagatgatcttctgttagaagaagacacctacgactacaaagtgattgcattgaacaacggtgtgccttctgcgccatcgccagttgcaactgttgtagctactaccaaccctaacccagaaccattgactggcgaagagcactatcaagctaagtgcgcaagctgtcacggtgatgacgctagcggtggtgtagttggtgttgctttgaatactgagcgcgatttaaccgttatgctgaacaccattgttactcgcatgcctccaggcgaagcggataactgtgatcaagagtgtgcggaagcaattggtggttatattcaaactactttctggaacggcggtgagccagagccagaattagcttgtgacactgttacttacggtgctcgtcagttgaagctacttaccaaagctgagtatcaacgttctgttgaagacttagttggtattgattacaacgtagcaagcggcttagcagaagataacattattggttacttcgttaataacaccaccaaagtggttgtgccaacggtttacgatcagtatctcacagtagctgaagaaatcgcgcagtggtctgctgacagaaactttgcgggtgcattaacttgtggcactaactttaaccaaacctgtgcgaatcagtttgttaacaacttcgctccaaaagtattccgacgcgcgctttctagcgatgaagctgcggcttacttggcgattgctaacggcagcgctaccaacggtgatgttaaagcgggtattcaacttgcgatggaaggcttgttctcttctccgcaatttgtatatagacacgagcttggtgaagccaatccaaataacaatgctatcgactctgacgcgtttgaattaacgtcttatgaaatggctacttggttgtcttacacttatgccggtaccacaccagatgcaattgctatgcaaaaagctgcaaacaatcagttgcgcacagacgcggaaattcgcgccgaagctcaacgtttgttagaaggtgctggtgcgaagcaaaaaatgggtgacttcgttgctagctggttaggtactgaccacattgcaaacgcacctaaagatgcttctgtatggcctggttttgatgcgttaattccgcatttacaaactgaaatacgcgaaatgttctcgtacgtaatgttagagccaactgaaagctttgcttcggtttacaacgctaactataccttcgtgaacggaccattggcgcaacactacggcattaacggtgtaagcggtaatgaattccaaaaagtaacaactaccgatcgcggtggcattttggcgaacggtgcgtttatggcgcgctggggtgaaagtgtagagtcttcaccaattcgtcgttctgtgcgcgtacgccgtcgtatgctttgtcaggatcaaccagatccccctggcaacgtaaacatcggtcgtgaaaacgctgcagacgaattccacgaggcgttggcagatcctactacgactaaccgtgagcgttatgagctgttaacatcaggtgaaacttgtgctacttgtcaccaagagtggattaaccctctcggctttggtatggaagatttcactgcggttggtacgcgtcgtgtgacggatctaaatggcaatactattgatgcaagcggtcaattgtacgcgccagaaaacctcaacgataaagacgtctttattaactttaacggtactcaaggtttaggtgcgttactgactaccttgccaagtgcgcagtcttgtttgccacaaaacttgttccgttattccgtgggcgttggtgtagaagggttggatgataatccagaaggcaacgagctagttcctgcagaacgggatggctatgcctgtgaagttaaaaacctgacgagcactatgttagagcaaagtccgcgagcaatgctggaaggcatgggttccatgcaagcggtacgttaccgcaaagcgtgggcgcgttaa

SEQ ID NO: 178 - protein, 933 aa, Microbulbifer degradans
MYPLPFNSKIVISLGAMTLALATQQAQALSCTVSADSWNSGYTANVTVVNDSSYSINSWDVTLGFNQPPSVSAGWNANVSTVGTTVMASNVGYNGNLSPGQSTSFGFQGAHNGNFELPSCAGGMTSSSSSSSSSSSSSSSSSSSSSSSSSSSSSSSSSSSSSSNSSSSSSSSSSSSTSSSSGSGGANTVTIELENLSGQNGFSPFSVQNDSSASGGQYIVWPNNGDQLLSGASDGQSGTLAVSFELSQTANVSFDIRASLANGNDDSFYYKLDSGVWSTQNNTSTSGFETLSPTTFNGVSAGVHTLYIQRREDGAKLDSLSLTASVGNIISSHANSSSSSSSSGSSSSSSSSSSSGGNELVIAINAGGGATSLDGVNFVADVHSLGGSTGSTTDSIAGATSSTLYQTERYGSYSYAVPVTNATYSLKLHFAEIYHTEAGARSFNLAVEGQQEMASVDLYSLSGHDGAYTYEVNDFPVDDGEVTISLESLTDNGTLSGFELSSSDGGEYVEPTPIPTPEPGEGGRYRVIHTTDMGADPDDEQSLVRQLVMANEYDLEGIITTTGCWKKSTSNTAYVDRILNAYSQAYPNLSKHAEGFPTPAYLDSINVMGQRGYGMGDVGSGKDSAGSNLIIAAVDKDDPRPVWATCWGGCNTIAQAVWKVQNTRSQAQLDAFISKLRVYDILGQDNAGTWLAKNFPNLIYIRARSVYSWQPSDSYLDNHIQSHGALGAVYPNRRYATEGDTPAFLHMANPGLNDPSVVSMGGWGGRFPSKQAGVRGMSCMSGEDAVYDTYYMYTENGESIKRWSTAIHNDFQARMDWAIESNYSAANHHPVPVVNNDANEAVMYLNASAGSTVSLDASGSSDPDGDSLNYSWSHYGEADSYSGSVSISNSSSASANVQIPSNAGGKDIHILLTLRDNGSPNLYAYRRVVINVQ

SEQ ID NO: 179 - protein, 108 aa, Microbulbifer degradans
MYWPPLALLSFCTLNGEKPFWPLKFSSSIVTVLAPPLPEEELVLELDELLLELEELEELEELEELEELEELEELEELEELEELEELEELEEDDEVIPPAQEGNSKLPL

SEQ ID NO: 180 - DNA, 2802 bp, Microbulbifer degradans
atgtatcccttgccatttaattcaaagatagttatttcgcttggtgcaatgacgctcgcgctggcgacgcagcaagctcaggcgcttagttgtacggtttcggccgacagctggaatagcggttatacggccaatgtaacagttgtcaacgatagtagttacagtattaatagttgggacgttacgcttggttttaatcagccgccaagcgtgagcgccggttggaatgcgaatgtgtctactgttggcaccacagtcatggccagcaacgtgggttacaatggaaacttgtcgcccgggcagtctacatcctttggttttcagggggctcacaacggcaattttgaattgccttcttgcgctggaggtatgacttcatcatcctcttctagttcttctagttcttctagttcttctagttcttctagttcttctagttcttctagttcttctagttcttctagttcttctagttcttctagttcttctaattcttctagctcgagcagcagctcgtcgagttctagtaccagctcttcttccggcagcgggggcgctaatacagtgactattgagctagagaatttgagcggccagaatggcttttcaccatttagcgtgcagaatgacagtagtgccagtggcggccagtacatcgtttggcccaataatggtgaccaactgctaagcggagcctccgatggccaatctggtactttggcagtgtcgtttgaattgtcgcaaacggcaaatgtgtccttcgatataagagcgagcttggcaaatggcaatgatgattcgttttattacaaacttgactctggtgtttggagtacccagaacaacacttctaccagcggttttgaaactctctcgccaactacctttaacggagtgtctgctggtgttcatactctttatattcagcgccgagaagatggagctaagctcgatagtctgagcctgactgcctctgtgggcaatattatcagcagccatgctaatagcagttctagttcttcttccagcggctcaagttcgtctagctcttcttccagttcaagtggtggtaatgagctagtaattgctataaacgctgggggcggtgccacatctctagatggtgtgaattttgtagctgatgttcattcattgggcggctccaccggttccaccaccgacagcatcgcaggcgctactagcagtactttgtatcaaacagagcgctacggcagctacagctacgctgttcccgtaactaatgccacttattcgttaaagctgcattttgctgagatttaccatactgaagcgggggcccgctcgtttaatcttgctgtggaaggtcaacaggagatggctagtgtagatctgtattcactgtcagggcacgatggtgcttatacctacgaggtgaatgatttcccggtggatgatggcgaggttacgatttcgcttgaatcacttaccgataacggcacgcttagtggtttcgagctttcctcctctgacggtggtgaatatgtggaaccaacacctatacctacgccagagccgggtgaaggcggtcgttaccgagtgattcacaccacggatatgggggcagacccagacgatgagcagtcgttggttcgccagttggtaatggccaacgagtatgacctagagggcattattacgacaacaggttgttggaaaaaatccaccagtaacacggcctatgttgacaggatcctcaacgcctacagccaggcatatcccaatttgagcaagcatgcggaaggattcccaactccggcgtatctggattccattaatgtgatggggcagcgtggctacggtatgggtgatgtcggctctggcaaagactctgccgggtccaacctgattattgctgcagtggataaagatgatccacgtcctgtatgggcaacttgttggggtggatgtaatactattgctcaggcagtgtggaaagtgcaaaacacgcgctcgcaagcgcaattggatgcttttatcagcaagttacgtgtatacgatattctcgggcaagacaatgcgggcacttggctggctaaaaactttccaaaccttatctacattcgcgcgcgatctgtttacagctggcaaccctctgatagttatctggataatcacattcagagtcacggtgcactgggtgctgtatacccaaatcgtcgatatgcaacagagggggatacaccagcatttctgcatatggctaatccgggattgaacgacccatcagtggtttccatggggggctggggtgggcgtttccctagcaaacaagctggtgtacgtggtatgtcgtgcatgagtggtgaagatgccgtctacgatacctactacatgtatactgagaatggcgaatccattaagcggtggagcactgcaattcacaacgactttcaggcacgtatggattgggccattgagagtaactattctgcagcgaaccaccacccagtacccgttgttaataatgatgctaacgaggcagtaatgtatctcaatgcgtctgcgggttcgacagtttcgctggatgctagcggctcgagtgacccggatggagatagccttaattattcgtggtctcactacggcgaagcggattcttacagtggttccgtgagcattagtaatagtagttcagccagcgccaatgttcagattccgtcgaatgctggtgggaaggatatccacattttgctaaccctgcgtgataacggttcccctaacctctatgcctaccgccgcgtggttattaacgtgcaataa

SEQ ID NO: 181 - protein, 584 aa, Microbulbifer degradans
MRCVLVKNYQIIKLKNYSHHVCWRKFMSTQGKPCLKKLWPALALAAAVASPNAFSACEYVVSNQWDSGYSATIKIHNDTNSTINGWNVNWQYSGDNRVTNLWNAAYVGSNPYSASNLSWNSTVGAGQTIEFGFQGAKNGGSAEVPVVTGDVCSGGGSSSGSSSSSSSSSSTGSSTSSSSSSSSSSSTGGSTSSSSSSSSTGGNGGAQQCNWYGEIRPLCNNQDSGWGWENQQSCIGRDTCSNQSGNGGIIGGSSSSSSSSSTGSSSSSSSSSSSSSSSSSSTSSSSSSSSSTSSSSSSSSSSSSSSSTSSSSSSSSSSSSSSSSSTSSSSSSSSSSSSSSSSSSSSSSSSSSSGGGVIFSADFESDSDSTQPAGWDNFIGWRQNGPNPNGSTFALVESGRAHSGNNAVHFSGGASPAMIARALPADLDTLYVRAWVYMTRQLGMNPGDNHETLIALRGSAGNANNEVRFGEIKGVIGTNEVPSDNIAPTMASWGGGPAYASDTWHCIEVAFLSQPAYDTVNAWVNDALVHTIDEGSDWNNGALEADWLSNKYVELAFGWHSFSGNDVDVWMDDIVVSTTPIGCD

SEQ ID NO: 182 - protein, 64 aa, Microbulbifer degradans
MEPPVELLEELLEELLVELPVELLDEELDDEPEELPPPLHTSPVTTGTSALPPFLAPWKPNSIV

SEQ ID NO: 183 - DNA, 1755 bp, Microbulbifer degradans
gtgcggtgtgtattagtaaaaaattatcaaataataaaattaaaaaattatagccatcatgtttgctggagaaagtttatgtcaacccaaggtaaaccttgtttaaaaaaattgtggccggcgttagcgcttgctgctgctgtagctagtccgaacgcattttctgcgtgtgagtatgttgtatccaatcaatgggattcagggtattcggcgactattaaaattcataacgatacaaattcaaccattaatggttggaatgtgaattggcaatatagcggcgataaccgcgtaaccaatttatggaatgcggcgtatgtaggtagtaacccatactctgcaagtaacctttcgtggaatagcaccgttggtgccggtcaaactatcgagtttggtttccagggggccaaaaacggcggcagtgccgaagtgcccgttgttacgggtgatgtgtgtagtggtggtggcagttcttctggttcatcatctagctcttcatcgagtagctctacaggtagttctacaagcagttcttcaagtagctcttcaagtagttccacaggcggttccacaagcagttcatcaagctcgtcttctaccggtggcaatggtggtgcacagcaatgcaattggtacggtgaaattcgcccactgtgtaacaatcaagatagcggctggggttgggaaaatcagcaaagctgtatcggtcgcgacacctgttccaaccaaagtggcaatggcggtataattggcggtagttcttctagctcgtccagttcttcaaccggttcatcgagcagctcttcgagttcttcgtcaagctcatccagctcttctagttcaacgtcaagctcatccagctcttctagttcaacgtcttcaagttcttcgtcgagttcatcatctagctcttcaagttctacaagtagctcgtcgtcttcgtctagctcatcgagtagttcttcaagcagttcgacgtctagcagtagttcttcatcttcgagctctagcagttcatctagctcttcaagcagttcttctagtagctcttcttcaagtggtggcggtgttatttttagcgcagacttcgaaagcgatagcgatagtacacagccagcaggttgggataattttattggctggcgtcaaaacgggccaaacccaaatggttcgacatttgcgttggtggaatcaggtcgcgcacacagtggtaacaacgctgtgcacttcagtggtggcgcaagcccagctatgattgctcgcgctttgcctgcagatttagatactttatatgtgcgtgcttgggtgtatatgactcgccaattgggtatgaaccccggtgataaccatgaaacgctcatcgccttgcgtggctctgctggcaatgcaaacaacgaagtgcgttttggtgaaattaaaggggtaattggtactaacgaagtaccgagcgataacattgcacctactatggcaagctggggtggtggccctgcctatgcatcagatacttggcattgtatcgaagtggcatttttatcgcagccagcgtacgacactgtaaatgcatgggttaacgacgcgcttgtacatactattgatgaaggctctgactggaacaatggtgccttagaggcggattggttaagtaataaatacgtagagctagccttcggctggcacagctttagcggcaacgatgtagatgtatggatggatgatatcgttgtatccacaaccccaatcggttgcgactaa

SEQ ID NO: 184 - protein, 788 aa, Microbulbifer degradans
MFTRITFMLINKARGRLAAAMLATAASAWGSTALAECSYQVTNNWGSGFTAAIRITNTQTSSINDWQVSWTYENNTLVNAWNANVSGNYTATNMGWNGSLTSGQSVEFGLQGTTTGGVVEIPLLTGNVCNSNTSSSSSSSTSSASSSSSSSGAAAVNLAGIANASTSYVSAWETLAAVNDGNTPANSNDKSNGAYGNWNNPNSIQWVQYDWPQNYTLSSTQIYWFDDNGGVLVPDVAYIEYWSNGTWVKVGDVPRQENTFNTLNLNNIVTNRLRVSISNTLQSTGILEWRVEGTEPSGSSSSSSSSSSSSSTSSSSGGPEQCDAYVWPEYEPNLNYDFRQDYADINPEEFEVFLGCDPSQVAGVKTSGWYAFIWGHNRNPAITDEDIDRVLANLNEDMAYARGEMGWPPDKLPQEGYYSNVYLYGSGLCTDNAANTERGGWQSSIAGYPMVLLSYYPVITPSERGGITHEAIHTIMASMGNKAAWFNEGGNTWLQMNMEASRVGDYGVGFLDGAPFLAPHMPIENYSGWLQDGSFGGPNAEGVHRELNGQQIATWRDYLGGHQYNSVFSHFLAQYVSSGANAWIWKNGPYNHILASLAAGLGDDQTRHLIMQYRARQAMVDFGPWTNGFKQPINNNWQRTIGAEETAAGKWMEPEPHQLTFYAATSQEGNTLIPAQNTLPGWSGANQIPLQVTGNKVRVDFEPFGNNMRLQLAYRAQDGSAVYSQPIESGEACLTLEKTPKNGVVVAIVSNTDYTYAGDETRKQKYDYRVHIQEGVSGTASLYSKHYE

SEQ ID NO: 185 - DNA, 2367 bp, Microbulbifer degradans
atgtttacgaggattacctttatgttaattaacaaagcgagaggtcgcttagctgcagcaatgttagccacagcagcctcagcttggggtagcacggctctagccgagtgcagctatcaagtcacaaataattggggcagcggatttactgccgccattcgcatcactaatacccaaacgagtagtattaatgactggcaagttagctggacgtacgaaaataatacacttgtaaatgcttggaacgcgaatgttagcggcaattacaccgctacaaacatgggctggaatggctcacttacctcgggccaatctgtcgagtttggcctgcaaggcaccacaactggcggtgtggttgaaatcccccttttaaccggtaatgtgtgcaactcaaatacaagtagtagctcttctagtagtacaagttcagcctcaagttcaagttcgagttccggcgctgccgcagtaaatctcgctggtatagccaatgcgagcacttcctatgtttctgcatgggaaacattggcagcagtgaatgatggtaacaccccggccaattccaacgacaagtccaacggagcttacggcaactggaacaatccaaattcgatacagtgggtacagtacgattggccacaaaactatacgttatcctcaacgcaaatatattggtttgatgataatggcggcgtactggtacccgatgttgcttacattgaatattggagcaatggcacatgggtaaaagtaggtgatgtaccgcggcaagaaaatacatttaacacgctaaatttaaacaatattgttacaaaccgcctacgtgtttctataagcaacacattgcaatctacaggcatactggagtggcgcgtagagggaacagagccaagcggcagctcatctagcagcagctcaagctcatcatccagctcaacgtctagtagtagtggcggaccagaacagtgtgatgcgtatgtgtggcccgaatacgagccgaatttaaattacgactttagacaggactacgcagatataaaccccgaagaatttgaggtatttttaggttgcgacccaagccaagttgcaggtgttaaaacttctggctggtacgcgtttatttgggggcataatcgcaaccccgcaattaccgatgaagatatagatagagtattggccaatttaaatgaagatatggcatacgctcgcggcgaaatgggctggccacccgataagcttcctcaggaaggctactacagcaatgtgtatttgtacggctctggtttatgtaccgataacgcagccaataccgagcgaggtggctggcaaagtagcattgccggctaccccatggtactgctttcgtattacccagtaataacacctagcgagcgcggtggtataacccacgaagctatccacactattatggcttcgatgggaaacaaagctgcatggtttaacgaaggcggcaacacttggctacaaatgaatatggaggcatctcgcgttggggattatggcgttggctttttagatggtgccccctttttagcgccgcacatgccaatcgaaaattacagtggttggctacaagatggctccttcggtgggccgaatgctgaaggcgtacaccgggaattaaatggtcagcaaatagcaacttggcgagattacttaggcggccatcaatacaactctgtgttttctcactttttagcgcaatatgtttctagcggtgcaaatgcgtggatatggaaaaacgggccatataaccatattctcgcctcgctagcagcgggcttgggcgacgaccaaactcgccacttaattatgcaataccgcgcacggcaagcaatggttgattttggcccttggacgaatggatttaaacaaccaatcaataacaattggcaacgcaccattggtgcagaagaaaccgctgctggcaaatggatggagcctgaaccccatcaattaacgttttatgctgcaacaagccaggaaggtaatactttgataccagcacaaaatacattgccgggctggtctggtgccaatcaaataccattacaagtaaccggcaacaaagtgcgtgttgattttgaaccattcggcaacaatatgcgcttgcaattagcctatcgcgcacaagacggttcagcggtatacagccagcctatagaaagtggcgaagcgtgcttaacactagaaaaaacacccaaaaatggcgtagtggtggcaattgtatccaacaccgattacacctacgcaggggatgaaactcgcaaacaaaaatacgattacagagtgcatattcaagaaggcgtaagcggtacggcatcactttatagcaagcactatgaatag

SEQ ID NO: 186 - protein, 787 aa, Microbulbifer degradans
MLRKLNFILAPLGMVLGVNTYADVSCAVSGSVWNNGYVANVAVTNAGESLQEGWSVALLFDNTPTINNSWSAELAVDGNVLTASNVAWNANLAAGQSAHFGFVGSYSGEFELPECFVGALDDDTALEDYLKQGVHNHLNLRIANSASGSSSSSSSSGASSSSSSSSASSASSTSSGSPVAEPDTQPDDITNTQEDGVDEADIIESDGNHFFVVRSSLYFTGTSSSTSGSSSSSASSSGSGGYGDYTQGVLIEAYSKDSAAGTTQHVGQVTLPYEENYLHVSGAYFRKTPQGNRLAIVSNTRESQPYYWSYGYGYYPYYQISNKVAISVANIDTPELMDEAERITFDGDLVSSRRIGSKLYIASRYSPNLNRLGFDFSSSASNEENAQRLDEAPLADLLPHVYDENGVGTPLVTAADCTVPEWPESVDVYAGSLLVITQIDLDNNLAISSRCLPASATEIYSSADAIYAFSNAFYAGVKVHKFTLKNDAQESEISYKGSVKLPGFIACSNQSYCFGEQDGALRVLYRVSNYSDATPYRIAVIKQSPSSAEGLDIIATLPNAERPASIGKPGEIVYAMRSFGDHAYVVTFDRIDPLYAIDFSNPADPYIAGELEVTGVSDYLHPVGENLLLGVGRDAIFDEARNLTWFQGVKVELFDVSDPTNLRSLGSEVIGKRESSTTLSFDARGIAFSHDENGIRFAIPVKMHDKPIGPANTDALNQYYSWTHTGLYVYQIETQPNTDASLSRLGILKTDIGEASVRYDRGVIDGDAVYYLHNYHMFSSLINYLAQ

SEQ ID NO: 187 - DNA, 2364 bp, Microbulbifer degradans
atgttacggaaattaaattttattttagcgccgcttggtatggtgttaggcgttaacacctatgcggatgtgtcgtgcgctgtttctggcagcgtgtggaacaatggctatgtagctaatgttgcagttactaacgcgggtgaatctctgcaagagggttggagtgttgctttgttgttcgataacactccaactataaacaatagttggagtgcggagcttgctgtagacggtaatgtgctaaccgcgagtaatgtggcttggaacgctaatttggcagcggggcaatctgctcattttggttttgttggctcatattcaggtgagtttgaattgcctgaatgtttcgttggcgcactagatgatgacactgcactcgaagattatttaaaacagggcgtgcataatcatttaaatttacgcattgcaaattcggcgtctggttcatctagctcttcgagctcttccggtgcgtccagttcttccagttcatccagtgcttctagcgcatcgagtacatcttctggttcgcccgtggccgagcccgatactcagcctgatgatattaccaatacccaagaagatggcgtggatgaggcggatataattgaatccgacggtaaccacttctttgtggtgcgttcttctttatattttaccggcactagctcatcaacctctggctctagttctagttcggcttcatctagcggttcaggtgggtatggcgattacacacagggagtgttgattgaagcctacagtaaagattcagcagccggaacaactcaacatgtggggcaggtgacgttgccctatgaagaaaattatcttcacgtttctggtgcttactttcgcaaaacaccgcaaggcaatagattagctattgtaagtaacaccagagaatcacagccttattattggagctatgggtatggttattacccctattatcaaatttctaataaggtagctatttctgttgctaatattgatacccctgaattaatggacgaggcagagcgaattacttttgatggtgatttagtatcgagcagacgtattggtagcaaattatatattgccagccgttatagcccgaacctaaatcgtttagggtttgatttttctagcagcgcgagcaatgaggaaaatgcacagcgtttagatgaagcgccccttgcggatttattgccacatgtttacgacgaaaatggcgtaggtacgcctttggttactgctgctgactgcaccgtaccggagtggccagaaagcgtggatgtatatgccgggtcactgttggttattactcaaattgacttggataataacttagcaattagctcgcgttgtttacctgcttcggcaacagaaatatacagttctgcggatgcaatttatgctttctccaatgcattttatgctggggtaaaagtgcataaattcacattaaaaaatgatgcccaagaaagtgaaattagctataagggtagtgttaagttgccgggttttatagcttgcagtaatcaatcttattgctttggcgagcaagacggggcattgcgcgttttgtatagagtgtccaattacagtgatgctactccctatcgtattgcggtaattaagcaatcgccaagctctgcagaaggtttagacattatagctaccttgccaaatgctgaacgcccagcctctattggtaagccgggcgagattgtttatgccatgcgtagttttggtgatcacgcttacgtcgttactttcgatagaattgacccgttatatgctattgatttctctaacccagcagacccttacattgccggtgagcttgaggttactggtgtgtctgattacttacatccagtgggggagaatttattgttgggcgtgggccgagatgcaatattcgacgaagcgcgcaatttaacttggtttcagggtgttaaagtggagctgtttgatgtgagtgaccctacaaacctgcgcagcttaggcagtgaagtaataggtaagcgcgagtcgtcaacgacacttagttttgatgcccgtggtattgcatttagccatgatgaaaacggtattcgttttgctattcctgtgaaaatgcatgataagccaattggaccggcaaataccgatgcgttaaaccaatattatagttggacccatacggggttgtatgtttaccaaatagaaacgcagccaaacaccgatgctagtttgtctcgcttaggtatactaaaaactgatatcggcgaggccagtgtgcgctatgatcgtggcgtaattgatggtgatgctgtttactatttgcataattaccacatgttttcgagcttaatcaattatttggcgcaatag

SEQ ID NO: 188 - protein, 681 aa, Microbulbifer degradans
MRISTAITQFLIVIATLILAACSGSGGGANSGGSNPGASSSSSSSSSSSNSSSSSTSSSSSSGGSSGAAVSLPSTIAAMDFVAAYDTDNANSGDCGNGPVDMQTSTDTQGAACTVGWTKAGEWLAYDVSVAVTQKMDIVFRVATNQNSRALKVQLNNKTLGVLNVSGTAFDEWQTVSLKDIEIPAGTHQLKLVWMTGAINVNTLSFTAHSAYGQTTNLWGSNGAEHDPSGVLSDWSYAGYHWGEEEPPVKSPTINVVTDHGAIADDDSDDSAAFIAALTAANNGDVVYVPEGRFILTQVLSIPNGVVLQGAGSELTTLYIPTNLNEATGIDPSFTGGFIEMKGSSSDGSKLSTITAAAARGSNQITVESVAGLTVGDWVQIQQTDVNGNFLLEALYAGYTAGLSDYSNLVNDAELEFFSRITNISGNTLTLERPLPITVSPNYMAELHSVSVAYGEVGFEGMTLEFPETTYPGHFNELGYNGIDMRAQHSWVRDVVVKNIDYGINLRGSHFVSILDFTVINTNDRSGHHGISVGSSTDCLIRGFDIQAELVHDLTVEWYAYGNVFTQGRGKNITLDHHRAAAYANLFTQIDLGEATRAWKTGGRSDRGYKTAVYSTFWNMTAEQAIDWPANDFGPRMVFMGLTMDGSHSSVLDWVVEDISADDIYPPNLWLSQREKRLGRQ

SEQ ID NO: 189 - protein, 66 aa, Microbulbifer degradans
MLGSDTAAPDEPPLEDDELVLLELLLDEEDEELELELAPGLEPPEFAPPPEPLQAARISVAITIRN

SEQ ID NO: 190 - DNA, 2046 bp, Microbulbifer degradans
atgcgtatttctactgctatcactcaattcctaattgtaattgctacacttattctagctgcctgcagtggctcgggcggaggggcgaattctggtggctctaatcctggtgctagttctagctccagttcttcgtcttcttcatctaatagcagttcgagtagcactagttcgtcgtcctctagtggtggttcatccggtgccgcggtatcgctcccaagcactattgccgcaatggattttgtcgcagcttacgatacagacaacgcaaattcaggtgattgtggtaatggccctgtcgatatgcaaacgtcaaccgatacgcaaggtgcggcctgcacggtaggttggacaaaagctggcgagtggttggcttatgatgtgagtgttgctgttacccaaaaaatggatattgtgtttcgtgttgctactaaccaaaactcacgtgccttaaaagtacagctaaataacaaaacattgggtgtgttaaatgtttctggtacagcgtttgatgaatggcaaactgtatcgctaaaagacatagaaattcctgcaggcacgcatcaattaaaactcgtgtggatgaccggggcaataaacgtcaatacccttagttttaccgcgcacagcgcctacggccaaactaccaatttgtggggcagtaacggtgccgaacacgacccgagcggcgtgttatctgattggtcttatgctggttatcactggggtgaagaagagccgccggtaaaatcgccaaccattaatgtggttaccgatcacggtgcgatagccgatgacgatagcgacgatagcgctgcgtttattgctgcattaaccgcagcaaataatggtgatgtagtttacgtacccgaggggcgttttattcttacgcaggtgctaagcataccgaatggtgttgtgttgcagggcgcaggcagcgaattaactactttatatattcccaccaacttaaatgaagcaacgggtatagatccatcttttactggtgggtttattgaaatgaaaggttcgtcgagtgacggcagtaaactttctactattactgcagcggcggcacgaggcagtaatcaaataacagtagaaagtgttgcaggtttaaccgtaggcgattgggtgcaaatacaacaaaccgatgtgaacggtaactttttattagaggccttgtatgcagggtacaccgcaggcttaagtgattacagtaatttggttaacgatgcagagttagagtttttcagccgcataacaaatattagtggcaacacacttaccctagagcgaccgctacccattaccgtaagccctaactatatggcggaattacacagcgtatcggttgcctacggcgaggtgggtttcgaaggaatgactttagagtttccagaaacaacctacccaggtcacttcaatgagttagggtacaacggcatagatatgcgcgctcagcactcttgggtgcgagatgttgtagtaaaaaatatagattatggtattaatttaagaggctcgcactttgtaagcattttagattttactgtaattaacacaaatgatcgcagtggccaccacgggataagtgtggggtcgtccaccgattgtttaattcgcggtttcgatattcaagccgaactagtccacgatttaactgttgaatggtatgcgtatggcaatgtatttacgcaagggcgaggcaaaaatattaccctcgatcatcaccgcgcagcagcctacgccaacttatttacccaaattgatttaggtgaagcaacacgcgcatggaaaacaggtggccgaagcgatcgcggatacaaaaccgcggtatacagtacgttttggaacatgaccgccgaacaggcgatcgattggcccgccaatgatttcggcccacgtatggtgtttatggggttaaccatggacggcagtcacagctctgttttagattgggtggtagaagatatttctgcagatgatatatatccaccaaacctttggttgtcgcaaagagaaaaaagattggggcggcagtag

SEQ ID NO: 191 - protein, 654 aa, Microbulbifer degradans
MRFQYALCTDSGGTIKNNQSWVSIMLRIHLAMPNMAFSLLQHYLLNTFSGVSIWVLCGLLMGAYVNAATQEINGNQLQVTCQSETFCDIHYRLNNGRELNIAMASLGNGEYAHTISNLISGDVIVYYLTYQQNGLAYDSERLTHIYGGASSSAGADPYLGFRAPIPGTILAVNYDTGGEGIAFHDATIGNSGGQYRDESVDIESASIGGFNVGWVASGEWLQYSVDVARAGSFDIVAQIASPNSGGSLHYEITGATNVQSDAVQFANTGGWQVWAHTAAAKVQLNAGAHTIRLVFESAGFNIHSLLVSEASSSFGKVEAESFDSMSGVVSEATSVGYFDRGDWMKYSAVSFGNLAKSITLSVAGEYNNGIAELRLDSVSGPVIGTYSMESTGGWASFKPKSFNIVHTLGVHDLYIVGKNGSGIFNLDYFQLSADVVEETNPATAVKAMSLNIYGWATMPQNADKYAALIRSRGVDVVGIQEGVEDWLIGPGFPTNYSKADALGAALGACWQQRYQIFINICEGNSFVSNRRFDMTDGPNATRTGESARINKNGFEYAVLTVHWDHQSGAAKVANAHETAAEVNYYGALPTVVVGDFNTGCTSHEVNTLMHEAGMVLIGNAGIDCILAKRFNGTAQTFDAAPSDHPGLDASLSTN

SEQ ID NO: 192 - DNA, 1965 bp, Microbulbifer degradans
gtgcgttttcagtatgcgttgtgcacagacagtggcggtacaattaaaaataatcaaagttgggtatctattatgttgcgaattcatctagccatgccaaatatggccttttcactattacagcactatcttttaaacacattttctggggtatccatatgggtactttgtggtttattgatgggggcatacgttaatgccgccacacaagagatcaacggcaaccagttacaagtgacatgccaaagcgaaaccttttgcgatattcattatcgtttgaataatggcagagaattaaatatagcgatggcgtcgttaggtaatggtgagtacgcacatacgatttctaatcttatttctggcgatgtgattgtttactaccttacgtaccaacaaaacggtttggcctatgactctgagcgcctgacgcacatatatgggggggctagctccagcgctggcgcagatccctatttggggtttagagcacctattccagggactattctcgctgtgaactacgatactggaggcgaaggcatcgcttttcatgatgccacaataggaaactctggtggtcaataccgcgacgaaagtgtggatatagagagcgcttcgattggtggctttaatgtggggtgggttgcttccggcgagtggctgcaatactccgtggatgtggcgagagctggcagtttcgatattgttgcgcaaatcgcctctcctaattctgggggcagccttcattatgaaattacaggggcaaccaatgttcaatctgacgcggtgcaatttgcgaatacaggtggttggcaggtttgggcacacacagcggctgcgaaggtacagctgaatgcaggtgctcataccattcggttagtgtttgaatcagcagggtttaatattcattctctgctggtaagcgaagcgagctctagtttcgggaaagttgaggcagaaagttttgattccatgagtggcgtagtgtcggaggcgacaagcgtaggctattttgatcgcggtgattggatgaaatacagcgcggtcagctttggtaatcttgccaagagcataacgttatccgtcgctggtgaatacaataatggtatagcagaacttagattagacagtgtcagtgggccggtgattggcacctactcaatggaatcgacaggtggttgggctagttttaagccaaagagttttaatatcgttcataccttgggagtgcatgatctttatattgttggtaaaaatggcagtggcatttttaatttagactattttcaattatctgcagatgtcgtagaagagaccaaccctgctacagcggtaaaagcgatgtcgctgaatatatatgggtgggcaacaatgcctcaaaatgctgataagtatgcagcgcttattcgttctcggggtgttgatgttgtgggtattcaagagggggtagaagattggcttattgggccgggttttcccacaaattactccaaagcagatgctcttggtgctgccttaggagcttgttggcagcagcgctatcaaatttttattaatatttgtgaaggaaatagcttcgtgtcgaatcgtcgattcgacatgaccgatgggcctaatgcaacgcgcacaggcgagtctgcacgaataaacaaaaatgggttcgaatacgcagtcttaacggtgcactgggatcaccaaagtggcgcagctaaagttgctaatgcacatgaaacagccgccgaggttaattactacggtgcattgcctaccgttgttgtgggcgatttcaacactggctgtacaagccatgaagtaaatacacttatgcatgaagctggaatggttttgattggtaacgccggcattgattgcattttagctaagcgattcaatggtacggcacaaacatttgatgctgcaccatctgatcaccctggcttggatgcgtcactcagtaccaactag

SEQ ID NO: 193 - protein, 550 aa, Microbulbifer degradans
MKSCCIKFFTTLCTAVYVLGCGALAHAQTGPAGYNYAAAENETVYLNGTTNVAYGANGSFYYAYNQTGSVNCSNQTFGDPIFGVRKACYTQQVASNNPPSVSFASPTGNLTVDEGYALSVTVNASDSDGSIASVELFINNQLVRQELYAPYEWGAAAEPDELNGLPVGTHTIKAVATDNDGDTKQASFKLTVRGAAVDVPGLVQAEDYTGFYDTTNGNTGGAYRNDNVDVETTSDSNGGYDVGWFAANEWLEYPINVTEAGNYVLEARVASAVGGGMFTAEINGNNSSTFSIGNTGGWQNWQTLNNNIGNLSTGKKTLRIQAQSGNFNLNWLRLKRATTSVCTLNTPAENIPTPFNLFTVIDTDLNRYEFCKASKWFEESNGKQVFKLFTGDNLADNVPGARVHARTEAGQGLKFKAGSTWHTFEARMKPSKKLDYTYTIAQLFAGCCGPQLRIEVKSNGRIHMGSRGNGNIRISDDQDYANGSRSFKIKIRTNGDQFEVYFNSSKKFSGRTDEAKNGNTSALYHFRWGVYSNEVMSEDLSNTVTEIIRN

SEQ ID NO: 194 - DNA, 1653 bp, Microbulbifer degradans
atgaaatcatgttgtatcaagttttttaccacactctgtactgctgtttatgtactgggttgtggcgcgttagcgcatgcgcaaactggcccggcgggttataactacgctgctgccgaaaacgaaacggtgtatttaaacggaaccaccaacgttgcctacggcgcgaatggctcgttttattacgcttacaatcaaaccggttcggttaattgctctaatcaaacctttggcgaccctatttttggggtgcgcaaagcgtgttacacccagcaagtggcgagcaataacccgccgtcggtttcgtttgctagcccaacgggcaacctaacagtcgacgaaggttatgctctttctgtaaccgtgaacgccagcgatagcgacggcagcattgccagtgtagagctgtttattaacaaccaattagtacgacaagagctttacgcaccttacgagtggggcgcagctgctgagccagacgaattaaatggcctacccgttggtacacacacaataaaagcggtagccaccgataacgacggcgacaccaaacaagctagctttaagctaacggtacgcggtgcggcggtagatgttcctggcttggtacaagcggaggattacacaggcttttacgacacaaccaatggcaacactggtggtgcgtatcgcaacgacaatgtagacgtagaaaccacaagcgatagtaacggtggttacgacgtaggttggtttgcggcaaacgaatggctggaataccccattaacgttaccgaagcgggcaattatgtattagaagcacgcgtcgcatctgctgtaggcggtggtatgtttaccgcagaaataaatggcaacaacagcagtacatttagcataggcaataccggcggctggcaaaattggcaaaccctgaataacaatattggcaatttaagcaccggtaaaaaaacgttacgcattcaagcgcaaagcggaaactttaatttaaactggctgcgcctcaagcgtgccacaacctctgtgtgcacacttaatactcctgccgaaaacattccaacgccatttaatttatttaccgttatcgatacagatttaaaccgctacgaattctgtaaagcgtctaaatggtttgaggaatctaacggtaaacaagtgtttaaattatttaccggcgacaacctagcagataacgtacctggcgcccgcgtacatgctcgcacagaagctggccaagggcttaagtttaaagcaggctccacatggcacacctttgaagccagaatgaaacccagcaaaaagttagactacacttacaccattgctcaattgtttgccggctgttgcgggccgcagttgcgcattgaagtaaaatctaacggacgcatccacatggggtcgcgcggtaacggcaatattcgtattagtgacgaccaagattacgccaacggctctagatcgttcaaaattaaaattcgcaccaatggcgatcagttcgaagtgtattttaacagcagcaaaaagttcagcggccgcacagacgaagccaagaacggcaataccagtgcgctttaccacttccgctggggtgtatattccaacgaagtaatgagcgaagatttatctaacactgttacagaaattattcgaaattaa

SEQ ID NO: 195 - protein, 500 aa, Microbulbifer degradans
MFASNLEDPTYYIKYKGVYMNTNRKQVNQNLIALLGLMLLMLFTPHGYAQDQCNTTLECKILHGDTATDCKNSRSDNSICMCGSTECAVDNPQPEPSNSAAVPGLIQAEDFTDYYDVTAANHGGAYRSTGVDIQVTTDTNGGYNVGWIAANEWLEYNINVLQAGNYTANIRVASNNGVGMYSLAVDGVTVSGTNTVNGTGGWQVWITQTANLGYLTQGEHTLRIAVQAGNFNINWLELLLAGTQQPDMLGVFNKSRDLLLANFDSRPDPDDIHSVAALATMLKDSRFSNVQYHAVSGAYGIQGGDYIEATHLFNLAFGAGNWSNAHTNRDVALTTVYNKVAATLTNGGDIWVQEAGQSDFSADLVRRIKQQLPAINTQTRIHIVQHSNWNQDKTTPADLTYVKNQTDYKKIADGNSTGNGTPGFNSSSSANWNRALNHAQVGAIWQEAKRIADNAIANHQGWQNPNIRDGGMDFSDAVEDCWIFGFNSLTNINSFFDEFL

SEQ ID NO: 196 - DNA, 1503 bp, Microbulbifer degradans
atgtttgctagcaacctcgaagaccctacttactatataaaatataaaggtgtttacatgaatactaataggaaacaagtcaaccaaaacctcatcgcgctattgggcttaatgttgctaatgctatttacacctcatggctatgcgcaagaccaatgcaacaccacgcttgagtgcaaaatactccacggcgatacagccacggattgtaaaaatagtcgctcagataacagtatttgcatgtgtggaagtactgaatgtgcagtagataatccacaacccgaacctagcaattccgccgcagtaccgggcctaatacaagcagaagactttaccgattactacgatgtaacggcggctaatcacggcggcgcttaccgctccacaggcgtagacattcaagttaccacagacaccaatggcgggtacaacgtaggctggatagccgctaatgaatggctagagtacaacataaacgtactgcaagctggtaactacaccgcgaatattcgtgttgcatctaataatggtgttggcatgtatagcttggcggtagatggtgtaacggtaagtggcaccaacaccgttaatggcacgggtggctggcaagtttggattacccaaaccgcaaaccttggctacttaacccaaggcgagcatacgttgcgtatagcagtacaggctggcaattttaatattaactggttagagctgctgctagcgggtactcagcaaccagatatgcttggtgtatttaataaaagccgcgacctgttgttagcaaatttcgatagccgcccagacccagacgatattcattcagtagcggccctggcaacaatgctaaaagattcccgttttagcaatgtgcaataccacgcagtatcgggtgcttacggtatacaaggtggtgattacattgaagctacacatttgtttaacttagcctttggtgccggtaattggtccaacgcgcacaccaatagagatgtggcgcttacaactgtttacaacaaagttgccgcaacgttaaccaatggtggtgatatttgggttcaagaggccggtcaatccgactttagcgccgatttggtacgcagaatcaaacaacagttacccgctattaatacgcaaacgcgaattcatatagtgcagcatagtaactggaaccaagacaaaaccactccagccgatttaacctatgtaaaaaaccaaaccgactacaaaaaaattgctgatggcaattccacaggcaacggcacgcctgggtttaactcatccagcagcgccaactggaaccgcgcactaaaccacgcgcaagtaggcgcaatttggcaagaagcaaaacgcatagccgacaatgccatcgccaaccaccaaggctggcaaaaccccaatattcgagacggcggtatggacttctcggatgcagtcgaagactgctggatattcggcttcaactcactcacaaatataaacagcttttttgatgagtttttatag

SEQ ID NO: 197 - protein, 473 aa, Microbulbifer degradans
MQLIQLLKTMGISRLCIFLFGAVLASTMLAGCGGSSSSEKSSGQVVTEPESEPESEPESEPESEPESEPESEPESEPDPAPDTAQDMRSEKRGLAYGYHSENDLKAMQGKVKWWYNWDTQADANVKENYASYGYDFVPMAWDENFNEEALRSFLDNHPDVKYLLGWNEPNFMEQANLTPAEAAAHWPVLEAIAQDYNLKLVAPAVNYSPGNVDIPGTDDDYDPWLYLDAFFEACEGCQVDYIAVHCYMKYESAFSWYVGEFERYNKPIWVTEWAGWDDGGPANMGEQMNFLSDTVRWMESNDNIYRYSWFLGRSSEGYDQFPYLDVLLADGELTPLGSVYTSIPSNDFRYKIPARIEAEGAHSLTGFKHLATTDTTGLAKLIAASNEVAEYKLNVEEGGDYTLALRLASSANSDIAIRVDGLLVYTFEDINTGGVEAWMTFSSTPISLTAGDHILRVESKSSRFGFNWLELTN

SEQ ID NO: 198 - DNA, 1422 bp, Microbulbifer degradans
atgcagttaattcagctactaaagacgatgggtattagtcggctatgtatttttttatttggtgccgtactcgctagcacaatgctagctggttgcggtggttcttcaagttcagaaaagtcctcaggccaagtggtgactgagcccgaatctgaaccagagtcagaaccagagtcagaaccagagtcggagccagaatctgaaccagagtcggagccagaatccgagccggacccagcgcccgacacagcgcaagatatgcgcagcgaaaaacgcggcttagcctatggctaccacagtgaaaacgacctcaaagctatgcagggtaaagtgaagtggtggtacaactgggatacccaagcggacgcgaacgtaaaagagaattacgccagttatggctacgattttgttcctatggcgtgggacgaaaactttaacgaagaagcgctgcgcagctttttagataatcaccccgatgtgaaatacctgctgggctggaatgaaccaaacttcatggaacaggccaacctcacaccagcggaagccgcagcccattggcccgtgctagaggccatcgcgcaggattacaacctaaaattagtcgcccctgcggtgaactacagccccggtaatgttgatattccaggtaccgatgatgattacgacccttggctatacctcgatgccttctttgaagcgtgtgaaggttgccaagtagattacattgccgtgcattgctatatgaaatacgaaagcgctttcagttggtatgtgggtgaatttgagcgctacaacaaacctatttgggtaaccgagtgggcagggtgggacgatggcggcccagcgaatatgggtgagcaaatgaacttcttgtccgatactgtgcgctggatggagagcaacgataatatatatcgctattcttggtttttggggcgcagtagtgaaggctacgatcagttcccatacctagatgttttactggccgatggcgaactaacaccgttgggtagtgtgtatacctctattccgtccaacgattttcgctacaaaatacccgcgcgtattgaggccgaaggcgcccatagcttaacgggcttcaaacacttagccacaaccgatactacaggtttagctaagttaatagccgcgtctaacgaagtagcagagtacaaattaaacgtggaagaggggggcgattacaccttagctttacgtttggcttcatctgcaaacagtgatattgccatccgtgtggatggcttattggtgtacaccttcgaagatattaataccggcggtgttgaggcgtggatgacctttagctcaacccctattagtttaaccgcgggtgatcacatattacgtgtagagtctaaatcgtcgcgttttggctttaattggttagagcttactaattag

SEQ ID NO: 199 - protein, 465 aa, Microbulbifer degradans
MKLLSITHTLKRAIASAVFVASAATASIANAVTVDILVLYDNYSANYFGGDPQTAMNGWANDMNSALKASQIDMKFRIVGVRHHEEDGAGMGDVLGNLRVDGGAIALRDQLGADMVSQLHEKGACGVGYVAVDKNYTWNVTHPGCGPMVMLHEFGHNMGVTHSRKQGDQGGTRYRYGVGYGVQDVFVDIMAYEGVFNTSRVNVFSNPNLNCRGLPCGKPVGDSEEAHASLAIHNVRNELANFRNTVNSGGPVRLFEHCYYTGYTVGLGEGSYRLADLMNRGLVNDDLSSLQVDAGYRVEMFQHDNFTGNVVTRTGSDDCLVDEGMNDDISSLRITRVSGGFSQTIQAENFFANNGVQLENTTDSGGGQNVGWIDANDWMAFSNITIPTTGNYRIEYRVAGFGGTLSLDLNGGAIVLGQINLPNTNGWQNWQTASHTVHINAGTYNFGIFANAPGWNINWFRIVQL

SEQ ID NO: 200 - DNA, 1398 bp, Microbulbifer degradans
atgaaattactctcaatcactcacacactaaagcgggcaattgcgagcgcagtttttgtcgcgtccgctgctaccgcctctatagccaatgcagtaacggtagatattcttgtgctttacgataattattcggcaaattattttggcggcgacccgcagacggccatgaacggttgggctaacgatatgaactctgcgttaaaagccagccaaattgatatgaagttccgcattgttggtgtgcgtcatcacgaagaagatggcgcgggcatgggcgacgtacttggtaatttgcgcgttgacggtggcgcaatagccctgcgcgatcaacttggtgcagatatggtgtcacaactccacgaaaagggtgcctgtggcgtggggtatgttgccgtagataaaaattacacatggaacgttactcacccaggctgcgggccaatggtaatgctgcatgaatttggccataacatgggggttactcactcgcgtaaacagggtgatcaaggtggtacccgctatcgctatggcgtaggttatggtgtgcaggatgttttcgtcgatatcatggcttacgaaggcgtttttaacaccagccgcgttaatgtattttctaaccctaacctcaattgcagaggccttccgtgtggtaaacccgttggcgattccgaagaagcccacgcttcactcgctattcacaatgtgcgtaacgaacttgccaattttcgcaataccgtaaattctggtggaccggttcgattgtttgaacactgttattacacgggttatacagttggcttaggcgaaggtagctatcgcttagccgatttgatgaaccgcggtttggtaaacgacgatttgtcatcgttgcaagttgatgcaggctatagagtggaaatgtttcaacacgacaactttaccggcaatgttgtaacgcgcaccggcagcgacgattgtttagtcgatgaaggcatgaacgacgatataagttcactgcgtataacacgagtaagtggcgggtttagtcaaactatccaagcagagaattttttcgctaacaacggcgtgcaactagagaatacaaccgatagcggtggcggccaaaacgtaggttggattgatgctaacgattggatggctttcagcaacattaccattccaaccaccggtaactaccgtatcgaataccgcgttgcaggttttggtggcacgctttcgctcgacttaaatggcggcgctatagtgctaggccaaattaatttacccaataccaatggctggcagaattggcaaaccgcatcgcacactgtacacattaatgctggcacttataatttcggtatttttgctaacgcacccggctggaatatcaattggttccgtatagtacagctttaa

SEQ ID NO: 201 - protein, 1024 aa, Microbulbifer degradans
MKKPPSRYSTLAITLCMSLSQAAIAKDIYVAPTGDDAGAGSFSSPYQTLAKAAQTAQAGDVVYLREGTYQETLRPANSGTASHPIVFQSYQNEKVIISAMEALSGWQQDTSNIYKTTVNWDLGQENFVMHKSTALDLARWPNNTDADPFTLNSKRNTGGSGPEVGQGAYIEYAAGLPNINWTGGTVFYYGDKPGGGWLAWRETIVSHTQTRINIDLSKKNPAWVRTAHDPASGGEFYLMGVKGALDYQNEWYFDSNTRELFVQLPNGARPQNGDIQFRKRLQTINLANRSHIHIKNIAVFGGAIEITNNANSNLLSGVSSFYGNATLGVHTGFSAPSYSVKIQGSDNRIENSEIAYGSGTGIYDSGTRSQIVNNYIHDFNTLGDYNAPVNARGGSNTLVKNNRISRGGRDTIQAFNRDSEWSYNDVSHSNLIADDCGLFYTVGGPHNVEIHHNWFHDAYSHGNKNKAAGIYLDNDARGFKVHHNVVWNTEWTGIQINWNGTDIDVFNNTLWNNSAAMGAWHKAGTAFSDVRVWNNLSNSNKWEEQANKQNNLTGTGDPFVNSQAGDFRLKANTAPIDYGRTIAGTTEGHSGANPDAGAYEYGATAWKAGVTWDITKGAANRCYQLPGEVCFDDTDTGGDIGELPGKVEAENYAHYYDTTPGNIGGAYRNQDVDIQPTTDTLGGYNVGWINAGEWLEYDIDVTQAGRYDAELRVASKLGAGQVAIAIDGVARGEALTIQSTGDWQNWATLTTQLGYLEAGLHTLRVSAMSGGFNLNWYNFTKQVSFGETAVGFTNTPPTRIPATRHQSFSVDYVANEPRELFLLFFNPDWSWVASTKTTVEPGKASTTLQLNLPFVPTAVQAFNVKLENRPIGANWDNPNNVEAHAAVTTQAAPLQHNGGFENGGTSGWNGYGSHALSTEAHSGSYAGKVTGGPSAFSQTIPNLTPNTTYSLSAFVKARAGHTGFLGVKEYGGQETSLIVNSTHYQKKTITFTTGPNASSAKIYLYVRDNNHVAFIDELVIVKVY

SEQ ID NO: 202 - DNA, 3075 bp, Microbulbifer degradans
atgaaaaaaccacctagccgttacagtacgctggccataaccctgtgtatgagtttatcgcaggccgctatagcaaaggatatctacgtcgcccctacaggagatgacgctggagccggatcgtttagcagcccctatcaaacgctggcgaaagcggcacaaaccgcacaagctggtgatgtcgtttacctgcgcgaaggcacctatcaggaaacgcttcgcccagcgaattcaggcacagccagtcaccccattgtgtttcaatcctatcagaatgaaaaagtgatcatcagtgcaatggaagccttaagcggctggcagcaagacacctcaaatatttataaaaccacggtgaactgggatctaggccaagaaaattttgtgatgcataaatctacagcactggatttagcccgctggccaaacaataccgatgcagaccccttcacgttaaattctaaaagaaacacagggggaagtggccccgaggtaggccaaggtgcttatatagaatacgcagcaggattgcccaatattaattggactgggggtaccgtattttattatggcgataaacccggtggcggttggctagcgtggcgcgagacgattgtaagccacactcaaacccgtataaatatagacctttctaaaaagaatcccgcgtgggtacgcaccgcacacgacccggcaagcggcggagaattctatttaatgggcgtaaaaggtgctttagattatcagaacgaatggtacttcgattcaaatacgcgagagctttttgtccaactgcccaacggcgcgcgcccacaaaatggcgatattcaatttagaaaacgcctgcagaccattaacttggcaaatagaagccacatacacattaaaaacattgctgtttttggtggcgctatagaaataaccaataacgctaattctaacctgctttctggggtatccagtttttatggcaatgctacgctcggtgtacacaccggattttcggcgccaagctacagcgtaaaaattcaaggcagcgataaccgtatagaaaacagtgaaattgcctacggctccggtactgggatatacgacagcggcacccgcagccaaattgtgaataactacattcacgattttaatacccttggcgactacaacgcgccggttaacgcgcgcggcggaagtaatacgttagtaaaaaataatcgaatctcccgcggaggccgcgacaccatacaagcttttaatcgagacagcgaatggtcgtataacgatgtttcccacagtaatttaatagccgatgactgcggcttgttttacaccgttggcggaccacacaatgtggaaatccatcacaactggtttcacgacgcatattcacacggcaacaaaaacaaagccgctggtatttatttagataacgatgcccgaggttttaaagtacaccacaacgtggtgtggaacaccgagtggacaggcattcaaataaattggaacggcacggacatagacgtatttaacaacacattatggaacaacagtgccgctatgggagcatggcacaaagccgggactgcgttttcggatgttcgagtttggaacaacctctccaacagtaataagtgggaggagcaagccaataagcaaaacaaccttacgggaacaggcgatccgtttgtgaacagccaagccggagattttagattaaaagccaatacggcccctatcgactatggccgcactatagcgggtacaaccgaggggcacagtggcgccaacccagatgctggtgcgtatgaatacggcgcaaccgcttggaaagcaggcgtcacatgggatataaccaaaggcgcagccaaccgctgctatcaacttcccggtgaggtttgctttgatgacaccgataccggcggagacattggtgagctacccggtaaagtagaagccgaaaactacgcccactactacgacaccacccccggtaatattggcggcgcctaccgcaaccaagatgtagatattcagcccaccaccgatacactaggtggctacaacgtaggctggattaacgctggcgagtggttagaatacgacatcgatgtcactcaggcggggcgctatgatgccgagcttagagtagcctctaaactgggtgcgggccaagtagccatagccatagatggggtcgctagaggcgaagcgttaacgattcagtcgacgggcgattggcaaaattgggcaaccctaacaactcaactagggtatttagaagcagggctacatacgctgcgggtatccgctatgagcggtggcttcaatctaaattggtataacttcactaaacaagtaagctttggggaaaccgccgtaggcttcaccaacactcctcctacacgtataccagctacaaggcatcagagcttttctgtggattatgttgccaacgagccgcgagaactgttcttattatttttcaaccccgactggagttgggtagcctcgacaaaaacaaccgtagagcccggtaaagcttctaccacgttgcaattaaaccttccctttgtgccaaccgctgtgcaagcatttaacgttaaattagaaaatcgccccataggcgccaactgggataacccgaacaatgtcgaagcgcacgctgccgttaccacgcaagcagcaccgctacaacataacggtggcttcgaaaacggtggcacctcgggttggaatggatacggtagccatgcacttagcacagaagcccacagcggcagctatgcaggcaaagtaaccggtggcccctccgcgttttcgcaaactattcccaaccttaccccaaacaccacctacagcctctcggcttttgttaaagcacgcgctggtcacacggggtttttaggcgttaaagaatatggaggccaagaaacgagcctgatagtaaacagcacccactatcaaaagaaaaccatcaccttcaccaccggccccaacgccagctcggcaaaaatttatttatacgttagggataacaaccatgtggcgtttattgatgagttagtcattgtgaaagtgtactag

SEQ ID NO: 203 - protein, 912 aa, Microbulbifer degradans
MKKILFLALGLLISQASFAQQTISSLAEFIALQDGSNQNIKMAPGTYHISSSSKSLFPGGDWRANVEGNWPGLFKFSGNNNTFDLTGVTFTFDSTILLEMPNLVHANLMEFGGSGNVWKGLNIQEKPNSKGEYGAFIHTSGGTIAVFTGDNHKVSDFTLKTRFSRPYGLGSLYGKTGNSSSTLPGVRLSKKTAMFLISLDDSYFENVLIDHSGFGHTLAFNGVDNVVFNTVEIIAESRSTDDLYANGIGGTDRNGVPFNVLFNGDELIGTNFADADYFLNLFDTDNFNQCQNMSGGVQYSPIRKGYQYSLTEDSFRGYYSAGSLGNIEIYNATVTGSRAGVVMEYASEGMIVDGMTVRGIAGHGVPACDGAWNSANGGEGDASAYGPPSNSVLKRAKADAAYSTVLEIPNFVDNVTADIEVLDPLNGYNRPSASNALALIKGDDHDIRLWKRDNQALTRDLVVKVSDADNLLLCNMTKQGVTVASSVTNSTIYSVGSISNSSGSSNTVVKLSSAADEPAICKALETNEVITDCGDFDAFAGIQAEAYCDMAGVEIESSSDDGGEQVGYINNNEWIAFNDVDFGNGASGFEARVSSATSGGNIELRLDSQTGALIGTCSVNGTGSWTTYETVSCDIGGVSGVQDLYLVFTGNSGYLMNVNWFNFTQAATNCSLPWSDSDFSVEKEIVNYSSGAIDISCASNVEISMNLEGVGAMEDADYLNVYYRVDGGAQQVISENVNAFSEKTVSVSGINGSSLEIIANVYTSYGAEIYTISDMSVKADSQTAYSLEVVSVLASADDGNVPANTRDGDLGTRWSANGDSQWITYDLGSSKTVTDVGIAFFRGDQRTAFISIETSTNNSTWQTVYSDEQSSSTTEIQNFDVTDSNARYVRIIGYGNSVNNWNSFTEVEIIGR

SEQ ID NO: 204 - DNA, 2739 bp, Microbulbifer degradans
atgaaaaaaatcctgtttttggccttaggccttttaataagtcaggcttcgtttgcccagcagacgatttcaagccttgccgagtttattgctcttcaagatggcagcaatcaaaacataaaaatggcccccggcacctatcatatatcatcatcgtctaaatcactgttccccggtggggattggcgggcgaacgtcgaaggtaattggccgggcctgtttaagtttagtggcaacaataatacgtttgacctgaccggcgttaccttcaccttcgactccacgatcttgttagaaatgcctaatcttgttcacgcaaacctcatggagtttgggggttccggtaacgtttggaaggggctgaatattcaggagaagcccaacagtaagggcgagtacggcgcttttattcatacctctggcggcaccatcgctgtattcactggggataatcacaaagtttctgattttactttaaagacacgtttttctcggccctatggtttaggttctctctatggaaaaacgggtaactcgtctagcacgctgcccggcgttcgcctgtccaagaaaacggccatgtttcttattagtttagatgatagttactttgaaaatgttctgattgatcacagtggctttggtcatacgcttgcctttaacggtgtcgataacgtggtattcaataccgttgaaatcatcgcagaatctcgctctaccgatgatttgtatgctaacggcattggcggaacagaccgcaatggtgtgccttttaacgtcctctttaatggcgatgaactcataggaacgaattttgccgatgccgattactttcttaacctgtttgatacggataacttcaatcagtgtcaaaacatgagcggtggcgtgcaatattcgcccatccgaaaaggttaccaatatagcctgactgaagattcgtttcgcgggtactacagtgctggttcccttggcaatatcgagatttataacgccaccgttacgggttcaagagcgggcgtcgtcatggaatatgcgagcgagggtatgattgtagacggtatgacggttagaggtattgccgggcatggcgtgccagcgtgcgacggcgcgtggaattcagctaacggtggtgaaggcgatgcttccgcctatggtcctccatcaaacagtgtacttaagcgtgcgaaagccgatgccgcctattccactgttttagaaatccccaattttgtcgataacgtgacggccgatattgaagtgttggacccgttaaacggttacaaccgtccttcggcatcaaacgctttggcgcttattaaaggtgatgatcacgatattcgactttggaaacgtgataaccaagccttaacccgtgacttggtggttaaggtgagtgatgcggataatctattgctctgtaacatgacaaaacaaggcgtgactgtcgccagcagcgtgaccaactccaccatttattctgttggtagcatcagtaattcaagtggcagttctaacacggtggtaaaactgtcaagcgcagctgacgagccagcgatatgtaaagctcttgagactaacgaagttataacggattgcggtgattttgatgcattcgccggtatccaagccgaagcctactgcgatatggctggcgttgaaattgaatcctccagcgatgacggtggcgaacaggttggttacattaacaacaacgaatggattgcattcaacgatgttgattttggcaatggcgcaagcggttttgaagcgcgcgttagtagtgctacctccggtggcaatattgagcttcgtttagacagccaaacaggcgcgttaattggcacgtgctctgttaatggaacgggcagttggacgacctatgaaacggtttcttgcgatatcggtggcgtcagcggcgtgcaggatttgtacctcgtgtttaccggaaatagtggctatttaatgaatgttaattggtttaacttcacgcaagctgcaacgaattgttctctgccttggagtgacagtgacttcagcgttgaaaaagaaatagttaactacagttccggtgctattgatatttcatgtgcttccaacgttgaaatttccatgaatctagaaggtgtaggcgccatggaagatgccgattacttgaacgtttattaccgcgttgatggcggtgcccaacaagtgatatctgaaaatgtgaatgcgttttctgaaaaaaccgtatcggtatcaggtatcaatggcagtagcttagaaattatcgccaatgtttataccagctatggcgcagagatttatacgatttctgatatgagtgttaaagctgattcgcaaacagcttattctctagaggttgtttctgtcttagccagtgcggacgatggcaatgtgcctgccaatacccgtgatggcgacctgggtacacgctggtcggctaatggtgattcgcagtggattacctatgatcttggcagcagtaaaactgtgaccgatgtgggcatcgccttttttagaggcgaccaacgcacggcatttatcagcatcgaaacctcaaccaataatagtacctggcaaaccgtttattctgatgagcagtcaagcagcacaacagagattcaaaattttgatgtgaccgatagcaatgctcgctatgtaagaattattggctacggaaatagcgtaaataactggaacagttttacggaggtcgagattattggtcgttaa

SEQ ID NO: 205 - protein, 541 aa, Microbulbifer degradans
LALSASLTQAATISNSGFESGFDGWTDTDPSALSSDANNGSRSAKITGSAGRVDQDVAVTPNTNYQLTAYVLGSGRVGVNTGTAVYDEAVNTSSWSKVTVNFNSGSANSVEVFGKYNSGTGRFDDFSLVETGTPTPTPTPTPTPTPTPAGCNSLNTIDISSATDDGSHDGHGPHLAVDGDLSADSRWSSKGDGKAITLDLGAEATVRQLKTAWYKGDSRTAYFDVETSTDKSNWSTALSNVQSQGSTGLKSNSIDDVTARYVRIVGHGNSSNTWNSLIEAQVLGCAGTVTPTPTPTPTPTPTPTPTPTPTPSGSKIPESITNSDVWDLEGENPHPLVDPYTLEFVPLEARVTTPNGNGWRHEYKIASSERTAMTATYEDFSATIKVDLSTGGKTIVAQHHAGDTGTIMKLYVSDTSESGFFDSVAANGIFDVYVRIRNTSGVEEKKPLGTIRSGDSFSFHVLNNYGVVKVSAFGKNLETEVEDDSASYLKFGNYLQSQYPQGSKDCGSHGDSDSFRACYEDIGITEAKITMTNVSYTRITK

SEQ ID NO: 206 - DNA, 1626 bp, Microbulbifer degradans
ctcgcgcttagtgcatctttaacacaggctgcgaccatttctaactcaggcttcgaaagtggctttgacggttggacagacactgacccttcggcactttctagcgatgcaaataacggcagccgatctgccaaaattactggctccgccggccgtgtagatcaagacgttgcggtaaccccaaacaccaactaccagttaactgcatatgtacttggcagtggacgcgtgggtgttaacaccggcactgcagtttatgacgaagccgtaaacacaagcagctggagcaaagtaactgttaactttaactctggctctgcaaactctgtagaagtgtttggtaagtacaatagtggtactggccgctttgacgatttcagcttagttgagacgggaacaccgactcctacgccaacacctactcctacgcccacgcctacaccagcgggctgtaacagcttaaataccatcgacattagctctgctaccgatgatggctctcacgatggtcacggcccacacctagctgtggacggcgatttatcagctgattcacgctggtcttctaaaggcgacggcaaagcgattactttagacttaggcgccgaagccacagttcgtcaactaaaaacggcttggtacaaaggtgactcacgtaccgcttacttcgatgtagaaacgtctaccgataagagcaactggtctaccgctttaagcaacgtgcagtcacaaggtagcactggccttaaatcaaacagcattgacgacgtaacagcgcgttacgtacgtattgttggtcacggtaactcgtcgaatacttggaacagcttgattgaagcacaagtattgggttgtgctggcactgtaacgccaacacctactcctacgcctacaccaactccgaccccaacgcctactcctacgccaactccatctggctcaaaaattcctgaaagcattacaaacagcgatgtttgggatttggaaggcgagaacccacacccattggtagacccttacacgttggaattcgtacctcttgaagcacgcgtaacgactccaaacggtaacggctggcgccacgagtacaaaatcgcttctagcgagcgtactgcgatgactgctacctacgaagatttctctgcaactattaaagtagacctatctactggcggtaagacaattgttgcacagcatcacgcaggcgacactggcaccatcatgaaactatacgtttccgacacaagcgaatctggctttttcgatagcgtagcggcaaacggcattttcgacgtgtatgttcgtattcgtaacaccagcggtgttgaagagaagaaaccattgggcacaatccgctctggcgactctttcagcttccacgtacttaacaactacggcgttgtaaaagtatctgcctttggtaaaaacctagagacagaagtagaagacgattctgcatcttacttgaagtttggtaactacctacaatcgcaatacccacaaggtagcaaagattgtggttcacatggcgactccgattcgttccgtgcctgctacgaagatataggcattaccgaagcgaaaatcaccatgactaacgtttcttacacgcgtatcactaagtaa

SEQ ID NO: 207 - protein, 1033 aa, Microbulbifer degradans
MGEAPVKKQAYTTTPVKPNALGLAIRTLALGGLAAGLVNVAHADLLSVNKTATASSEMQAAAYAFDNNQNTRWESAHAVDPTSISVDLGETYDLDSIVVHWEAANAASYTIEGSDNGVNWTQIGTYTGGTFGNRTDTVNVDGNYRHVRLNGTQRSDGNAWGYSIWELEVHGTEVTEPPVVEPPTEPGENLAIYGTATASSGNADVAIDNNAGTRWESDHGIDPSSFTLDLGATYSLNQVVIDWEAANAKVYAIQGSNDGTNFTTLANYSGGEFGTRTDTLNIAGDYRYVRLLGTERSDGNAWGYSIWEFKVYGGGKTEPPVTEPPVTEPPVVEPPIFTDLNYQPLFNNTHSPDTAQEWYTKPDGTVVTIASGRARSRHESEDIFYTFPTHYFEHRTFEIEIHDHTPKGQNLVEVFYHPEYANYVPPGCRSSYSNVWRADFNNNAGMDEKLQTATPDGKGERWVCRIQRDAHNGDDGILDVGSWMEFELQQFLGLYEGDPNVRGQAVYYTDTYRFKLGQPGIYIVGDEAMEEKIRAGGRATAPYVKGGDSVPVNEVISVNGDNTLTYKVMANGKWTQKDNPNGTVVTFPIRDGIEVYDNYVVASGVADWTTYFREALNIQWDTHNAFMQGRRVFHTRMDTGVHEEVGNPDFPELANIADGLMVKNSCLGCHVNNGRGIAPQNGALLDTLVVKVGSGAFDNLGQPQPHSYYGGVLQNLSLDAAVPAEGSVRVTYTAQNGTFNDGTGYSLQVPTYSLEMNDTNGGAIQHISPRMPQNITGLGLLEALPENEILAWHDPDDSNGDGISGRANVVTSPETGQQFIGRFGWKASSASLRDFAATALSGDMGVNTSVLPNADCGAQQTACIQNSGQGVELSDLRLNELVVYLQALGAPSRRPETVDQPMVVAGEQRFTDIGCASCHRPEMNTGHKHDLAELRGNVIRPYTDMLLHDMGPGLADSLTQAPELNREWRTAPLWGLGMNLAVNGHDNLLHDGRARSIEEAILWHGGEAQASNNAYKALSAQQRAELIAFLRSL

SEQ ID NO: 208 - DNA, 3102 bp, Microbulbifer degradans
gtgggagaagcacctgtgaaaaaacaagcttatacaactacaccagttaaaccaaatgcgttaggtttagccattcgcacactggcccttggtggcctagctgcgggacttgtaaacgtagcgcatgcagatttattgtcggtaaataaaactgctacggccagcagtgaaatgcaagctgcagcttacgcattcgataacaatcaaaatacgcgctgggaaagtgcgcacgcggttgatccaaccagcataagtgtagacttgggcgaaacctacgatttagatagcattgtcgttcactgggaagctgccaacgctgcaagctacaccatagagggctccgataacggtgttaactggacgcaaataggcacctataccggtggtacctttggcaatagaaccgataccgtaaacgtagatggtaattaccgtcacgtgcgattaaatggtactcagcgcagcgatggcaatgcatggggttactccatatgggagctggaagttcacgggacagaagtaaccgaaccacctgtagtggaacctcctacagagcctggcgagaatttggcaatatatggcacggcaaccgccagctctggtaacgccgatgtagctattgataataacgctggtacgcgctgggagagtgaccacggcatcgacccttctagttttactttagacctaggcgcaacctacagcttgaaccaagtggttatagattgggaggccgccaacgccaaggtgtatgctatccaaggctctaacgatggcactaactttactacccttgctaattacagcggcggtgaattcggcacgcgtaccgatacattaaatattgctggtgattatcgctatgtacgcctgttgggtactgagcgcagcgatggcaacgcatggggctattctatttgggaatttaaagtatatggcggtggaaaaactgagccaccggttaccgagccacctgtgacagaaccgccagtggtagagccccccatttttaccgacctaaattatcagccactgtttaacaacacacacagcccagatactgcgcaagagtggtacaccaagcccgacggtacagtggtaacaattgcaagtggccgcgcgcgttcacgtcacgaatcggaagatattttttacactttcccaacgcattattttgagcaccgtacatttgaaatagaaattcacgaccatacccctaagggccaaaatttggtggaggttttctaccacccagaatacgccaactatgtgccgccgggttgtcgctcttcttacagcaatgtttggcgtgcagactttaacaacaacgccggcatggatgaaaaactgcaaaccgccaccccagacggtaaaggtgagcgttgggtatgccgcatacagcgcgacgcgcacaatggcgacgacggcattttagatgtgggttcatggatggagtttgaattacaacaattcttaggcttatatgaaggcgaccctaatgtgcgtggccaggccgtttactacaccgatacataccgttttaaattaggccagcccggtatttatattgtgggcgatgaagccatggaggaaaaaattcgtgcgggtggccgcgctacagcgccttatgtaaaaggcggcgactcggtacctgttaacgaagttatttcggttaatggcgacaacacacttacctacaaagtaatggcaaatggtaagtggacgcaaaaagataaccccaacggcactgtagttactttccctattcgcgatggcattgaggtatacgataactacgtagtggcgagtggcgtggccgattggaccacctatttccgcgaagcgttaaatattcagtgggatacgcacaacgcatttatgcaggggcggcgcgtgtttcatacgcgtatggataccggcgtacacgaagaagtgggtaacccagactttcccgaattggcaaatattgccgatggtttaatggtgaaaaattcgtgcttgggttgtcatgtaaacaacggccgcggtattgctccgcaaaacggcgcgttattagatacgctagtcgttaaagtaggctcgggtgcgttcgataaccttggccagccacaaccacacagttattacggtggtgtactgcaaaacctatcactagatgctgctgtgcctgcagagggttcggttcgtgtaacttacaccgcgcaaaacggaacctttaacgacggcacaggctacagcttgcaagtgcctacctattcgttagaaatgaacgataccaacggcggggctattcagcatatttcaccgcgcatgccacaaaacataactggtttaggcttattagaagccttacccgaaaatgaaattttggcatggcacgacccagatgatagcaatggcgatggtatttctggccgcgctaatgttgttacctcaccagaaacggggcaacagtttataggtcgctttggctggaaagcgtcatcagcaagtttgcgtgattttgctgcaacggctttaagtggcgatatgggtgtaaatacctctgtgttacccaatgcagattgtggcgcacaacaaaccgcctgtattcaaaatagcggtcagggcgtagagctaagcgacctgcgtttgaatgaactggtggtttacttgcaagcgctgggcgcgccttcgcgcaggccagaaactgtagaccagccaatggtagtggccggtgagcagcgttttaccgatataggctgtgcctcgtgtcaccgaccagaaatgaacaccggtcataagcacgatttagctgagttgcgtggcaacgttattcgcccctataccgatatgctgttacacgatatgggcccaggtttggcagatagcttaactcaagcgccagagctaaatcgcgaatggcgtacagcgccgctgtggggcttgggcatgaacttggctgtaaacggtcacgacaacttgctccacgatggtcgcgcacgcagtattgaagaagccattttatggcacggtggggaagcgcaagccagtaataatgcctataaagcactaagtgcgcagcagcgagcagagttaatagcgtttttacgctcactctaa

SEQ ID NO: 209 - protein, 557 aa, Microbulbifer degradans
MLHISVQPNLTRSISGFLLGLAGVVSGSAYAQWNPAPNWEDSYSVNGVCYCNSSNYDHGLSAKTAPTPIGELNVVDICTDIKAVLGEGATNGRIPFNDIQCGNGPANDAADEAGCPGRVDIGSAGCDVIGPKWDLVSVYGPWPDGGLNRDAWEVSASNGSGSAQLALDGLASTRWATGVFQSPGQYFDIDFQDALTFDSIVLATTENPEDYPRAYEVYISSNGSDWGVPVVTGAGNGSTTTIELDTVTTRYLRILQTGSSSNRWWSIHEFNIFNSGPIPPEPEYPALDRSDWTVSASVNGAEAEFAIDSSPNTRWDTAQSQRAGQSFEVDLGELNTLAAIELDSAGSANDYPRGYAVYVSNDGSNWGSAIASGAAVSASTTIEFTPVSARFVKIEQTGGDGHYWWSIHNLNIFGEPSDNPQPTIELLDSTPWSLAANRRNSAAGNAIDNNQSTRWTTGQTQRDGQTFEIDLSTVQTFSRIVLDSAASDDDHPRNYELYVSNDGSNWGSPVATGAGDSSGVTVIDFPSVTARYVLIAQAGSDSSHWWSIHELSIYNVQ

SEQ ID NO: 210 - DNA, 1674 bp, Microbulbifer degradans
atgctacacatctctgttcaaccaaatcttacccgctctatttctgggttcttgttgggcctagcgggcgttgtctcgggctcggcttacgcgcagtggaacccagcacccaactgggaggacagctattctgtgaatggagtttgctactgtaattccagtaattatgatcatgggctaagcgccaaaacagcacctactcccattggcgagcttaacgttgtcgatatatgtaccgacatcaaagccgtgcttggtgagggggcaacgaatggacgtattccatttaacgacattcagtgtggtaacgggcccgccaacgatgctgccgatgaagcggggtgcccaggccgagtggatattggctcggcagggtgtgatgtgattgggcctaaatgggatttggttagcgtttacgggccatggccagatggcgggcttaatagggatgcttgggaagtgagtgcctcaaacggttctggtagcgcgcaactggcgcttgatggcttggcgagtacgcgctgggcgacgggtgtgtttcaatcgccaggtcagtattttgatattgattttcaagacgcgctaactttcgattcaatagtacttgctaccaccgagaacccagaagattacccaagggcttacgaggtttacatttcatcaaatggcagcgactggggagtaccagtggtgacgggagccggtaacggctccactacaactatcgagctagatactgttaccactcgctacttaagaattttacaaaccggcagctcatctaaccgttggtggtccattcatgaatttaacatattcaattctgggccaattccgccagagccagagtacccggcattagatagaagtgactggacagtttctgcatcggtaaatggcgcagaagccgaattcgctatcgactcttcacccaatacgcggtgggatacagcacaaagccaacgagcagggcagagttttgaggtagatttaggagaactcaacacgctagcggccattgagctggattcagcaggcagtgccaatgactatccgcggggttacgccgtttatgtatcgaacgatggctcaaactgggggagcgctatcgcttctggcgctgcagtaagcgcgtccacaacaatagaatttactccagtaagcgctcgcttcgttaaaatagagcagacgggaggtgacggacactattggtggtctatacacaacttaaatatttttggtgagccttcagataacccacaaccgactatagagctactcgatagcactccctggtctctagccgcgaacaggcgaaatagcgcggctggcaatgccatagataataaccagtctacacgatggaccacgggccagacccagcgcgatggtcagacgttcgaaattgacctgagcactgtgcaaacctttagccgtattgttttagattccgcagcgagtgacgatgatcaccctcgcaattatgaactttatgtctctaacgatggttctaattggggcagcccagtggcaaccggtgcaggagatagtagcggagtaacggtaatagatttccccagcgtgaccgctcgctatgtacttatagctcaggctggctcggatagctcacactggtggtccattcacgagttgagtatttacaacgtacaataa

SEQ ID NO: 211 - protein, 674 aa, Microbulbifer degradans
MKIIRLLVLCLGVVSSVVAVASSSEPHDEGNALESALWDTLTIPVCWENPEAFPVEEQAWVRKAVERTWEQESLVRFTGWGECGANDDGIRILVDDVGPHVKQLGSRLDGYVNGMVLNHTFQNWGTSCSYRRQYCAEVIAVHEFGHALGFAHEQNRDDTDDMCAAEAQGTDGDIYVGAWDLDSVLNYCNPEWNGAGNLSDTDIEMVQLFYGQPIETSGNEPVAICSVSASSSDGNIAENTLDGDYATRWSANGDGEWIQFNLCESQVADRVELAWYKGDTRSSTFSIEYITTDGYVWYTTPVRRYSSGASLGLESASFTAAEIQSLRITGYGNSSNTWNSITEAVIYTPSAGLDYPNLVAPTDVAATVTGQSQITISWADTNSEEESYFVEARIGGNDFFAIGLTEANATSYTHTDLIAEGLYEYRVTAVSGIIRSNFAAASVYFQPAGGSQANLVRPENFTVTANAQGQIALSWVDVSEGEEGYTLEYKLSSEAEFTVIELAANADSAIVSDLAAGSYYFRVSSYFGNNASEYSELLVTVFASEATIVPVDVYASSDDGNVASNVFDNDYSTRWSAFGVGENLTIALGDNYLVTDMRIAWYKGDQRQTRFQVEVSDDNQTWVQVFDGINSGESLSLETTFGGDYRASYIRIIGLGNEFNNWNSITEVSIKGHL

SEQ ID NO: 212 - DNA, 2025 bp, Microbulbifer degradans
gtgaaaatcatacggttgcttgttttgtgtttgggggtagtaagttctgtggttgcggtagctagtagctcagagccacatgatgaaggtaatgcattagagagtgcattgtgggatacgttaactattcctgtgtgctgggagaatccagaggcttttcctgtagaagagcaagcttgggtaagaaaagcggttgagcgtacttgggagcaggagtcattagtccgcttcaccggttggggcgagtgtggggcgaacgatgatgggatacgtattttagtggatgatgttgggccgcatgttaagcagctaggctcgcgtttggatggctatgttaatggcatggtactaaaccatacattccaaaattggggcaccagctgcagttaccgtcgtcaatattgtgcagaagtgattgcagttcatgagtttggtcatgctctaggctttgcccatgaacaaaacagagatgacaccgatgatatgtgcgcggccgaggcgcagggtactgacggcgacatttatgtcggcgcctgggacttggattcggttttaaactattgcaaccctgagtggaatggcgcgggcaatctaagcgataccgatatagagatggttcagctgttttacggtcagcccattgaaacgtctggtaacgagcctgtagctatttgtagtgttagcgccagttcaagcgatggcaatattgcagaaaatacgctagacggcgattacgctacgcgttggtctgcaaacggcgacggcgagtggatacaatttaatttgtgtgaaagccaagtcgcggatcgtgtcgagttagcttggtataagggagatactcgctcaagtaccttctctattgagtatataactaccgatggttacgtttggtataccacgcctgttcgtcgatattcttccggtgcttcgctaggcttggaatctgcgtcatttactgcagctgaaattcagtccttgcgtattactggctacggcaactcgtctaacacttggaatagtattaccgaagcggtaatttatactccaagcgctgggctagattaccctaacttagttgcacctacagatgtggcggctacggtaacagggcaatcgcaaattactatttcatgggcagatactaatagcgaagaagaaagctattttgttgaggcgcgtattggtggcaacgattttttcgctataggtcttactgaggcgaacgcaacatcttatacgcataccgaccttattgctgaaggcctttacgagtatcgtgttactgccgtaagcggcattattcgctcaaactttgcagctgcaagtgtatattttcaacctgcaggcggctcgcaggctaatcttgtgcgcccagaaaacttcactgtaacagctaatgcgcaagggcaaatagcactaagttgggtggatgtaagtgaaggcgaagagggttataccttagagtataagcttagtagtgaagctgaatttactgtaattgagctagctgcgaatgccgattctgcaattgttagcgatttggctgcgggtagttactattttcgtgtaagcagttatttcggcaacaatgcttctgaatacagcgagcttttggttactgtgtttgcatcagaagcgactattgtgccggttgatgtttatgcatctagtgatgatggcaatgtggcaagcaatgtttttgataatgattactctacgcgatggtcggcttttggtgtaggtgagaatttaaccattgcgctgggggataattatctcgttaccgatatgcgcatagcgtggtacaaaggtgatcaacgtcaaacccgctttcaggtagaggtgagtgatgataaccaaacctgggtgcaagtgtttgatgggattaactcgggtgagtcgttaagtttagagacgacgtttggcggtgattatcgcgcaagctatattcgaattatcggtttgggtaatgagtttaataactggaacagtattactgaggtaagcattaaagggcacctctag

SEQ ID NO: 213 - protein, 818 aa, Microbulbifer degradans
MIKLSHLKHCRKFCISLLCALGMANAHAALNVTASADDGNVPANTLDDNIDTRWSANGSGQWIEYDLGATHTVDAVQIAFFRGDVRDATIDIQVSNDGGNWQTLFSGTPPTRTLAQQHFELDDTSARYVRIVGYGNSQNNWNSITEFDVVTLASGENIALGKATSQSSTGYEGVSSRAVDGNTNGNWNQGSITHTNNEYQPWWQVDLGSVRSIDQVNLWNRTNCCSSRLSAFYVLVSDVPFTSQTLSGALSQAGVSAYYFNDTAGSPTEINIDRTGRYVRVQLSGTNPLSLAEVEVIEGSEIVPPAPTGPDASWTYCAAEREQCAFSNIKEVAYGAGDSWNYSVELDGVTCNNTNLGDPVRGTVKSCWVRNAQQNYVAVRNLAELQNAISNSNQHIRMKRGVYEATALMSDNTTVFRFDGANNVLDFTGVTIQVPTKLLNSMSTQPIHSQVTYDVMGDNITFLNGTFENTYPNGQHDVTDFTAHNKNPDYWPARQMTEFRVWGNGVQFLNNTITVRGSYPYGYGDMLGKGAGSAVYLRKHAGVQISGDNVLIDGMKLTVLAFGHGIFMQGADNTVIKNSVVQGRMRLGADMYNDGPDSLMGPFNFEQQYPDHFVGLPIVRDLMYNLTEDGIRAYTQGTKLDGSVVRTGAITVEDTKVINMRGCITTPLASKPSYIKNVEIQGCSVGYALANNSDVINSRGDAGYGPLLHSTYDTRNNANVEITVTNIPSTGSHAFAYIAGSGHNITFLSDGSNPDVPREIRVGDTGDRWAGDPSYQDAANILLINETNQPVVLTETSRNITGESVGEVTDNGTGNSLK

SEQ ID NO: 214 - DNA, 2457 bp, Microbulbifer degradans
atgataaaactatctcacctcaaacactgcaggaaattttgtatttctttgctttgcgcgctgggcatggctaatgctcacgccgcattaaatgtaactgcatctgcggatgacggcaatgtgcccgcgaataccttagatgacaatatagatacgcgctggtcggcgaatggatctgggcagtggattgaatatgatttgggcgcgacacacactgtggatgctgtgcaaatagcattttttcgcggagatgtgcgcgatgcaaccatcgacattcaagtgtcgaacgatggcggcaattggcaaacacttttttcgggtacgccaccaacccgaaccttagcgcagcaacattttgagttggatgatacttctgcgcgctatgtgcgtattgtaggttatggtaacagccaaaataattggaacagtattaccgagttcgatgtggttacgcttgcaagtggagaaaatattgctcttggtaaagctacatcccaatcatccactggctatgagggtgtatctagccgtgcggtagatggcaacaccaatggtaactggaatcaaggctcgattacccacaccaataacgagtatcaaccttggtggcaagtggatctaggctcagttagatctatcgaccaagttaacttgtggaatcgtaccaactgctgcagctcgcgtttatcggcgttttatgtgttggtgtccgatgtgccctttacatcgcaaaccttaagcggtgcgcttagtcaagcgggtgtaagtgcttattattttaatgatactgcgggcagcccaaccgaaataaatatagatcgcacaggtcgctatgtgcgtgtacaactttctggcacaaacccattaagcctagcggaagttgaagttattgaaggcagcgaaattgttccaccagcaccaaccggcccagatgcatcatggacttattgtgccgccgagcgcgagcaatgtgcattttctaatataaaagaagtggcctacggcgctggcgatagctggaactactctgtcgagctagacggcgtaacttgtaataatactaacttgggtgaccccgttcgcggcacggttaaatcgtgctgggtacgcaacgcacaacaaaattatgtggcggtgcgaaaccttgctgaattgcaaaatgctatttccaatagcaatcaacacattcgcatgaagcgcggtgtgtatgaagctacagcgttaatgtctgataacaccaccgtatttcgattcgacggtgcgaataatgtattggattttaccggtgtaaccattcaggtacccactaaactcttaaacagtatgagtacccagcctattcactcgcaagtaacctacgatgtgatgggcgataacattacttttttaaacggtactttcgaaaatacctatccgaatggccagcacgatgtaacagattttaccgcccataataaaaacccagactattggcccgcgcgtcaaatgacggagtttagagtgtgggggaacggcgtacagtttttaaataacaccattactgtgcgcggttcatacccgtatggctacggtgatatgttaggtaagggcgccggttctgcagtgtatttacgcaaacatgctggtgtacaaatttctggcgacaatgtattaattgacggcatgaaattaaccgtacttgcattcggccacggcatttttatgcagggtgcagataacacagtaattaaaaactctgttgtacaagggcgtatgcgcttaggcgccgatatgtataacgacgggccagactccttaatggggccgtttaattttgagcagcaatacccagatcactttgtgggcctgccaattgtgcgcgacctaatgtacaaccttaccgaagatggcatacgcgcttatacacaaggcaccaaattagatggtagtgtggtgcgtactggtgcaattactgtagaagacaccaaagtaattaatatgcgcggttgtattactacgccattggcttctaagccaagttatataaaaaatgtagaaattcaaggttgtagtgtgggttacgcgctggcgaataatagcgatgtaatcaattcgcgcggtgatgcaggctacggtccgctattgcactctacgtacgatacgcgcaacaacgccaatgtcgaaataaccgttaccaatattccatctaccggctcacacgcttttgcgtatattgcaggctctggtcataacattaccttcctaagtgatggcagcaacccagatgtgccgcgcgaaatacgcgtaggcgatactggcgaccgctgggctggcgacccaagctatcaagatgcagcaaatatattactcataaacgaaaccaaccaaccggtggtgttaactgaaaccagtagaaatattactggtgaaagtgtgggtgaggtgactgataatgggacgggaaatagcttgaaatag

We claim:

1. A method for producing saccharides from lignocellulosic material, comprising:
  providing lignocellulosic material;
  providing a microorganism producing a degradative enzyme mixture derived from *Saccharophagus degradans* 2-40;
  lysing the microorganism to obtain the degradative enzyme mixture; and
  treating the lignocellulosic material with the degradative enzyme mixture derived from the *Saccharophagus degradans* 2-40, thereby degrading the lignin, the hemicellulose, and the cellulose part of the lignocellulosic material to obtain saccharides.

2. The method of claim 1, wherein the degradative enzyme mixture comprises three or more of the following:
  at least one of the compounds listed in FIG. 4,
  at least one of the compounds listed in FIG. 5,
  at least one of the compounds listed in FIG. 6,
  at least one of the compounds listed in FIG. 7,
  at least one of the compounds listed in FIG. 8,
  at least one of the compounds listed in FIG. 9,
  at least one of the compounds listed in FIG. 10, and
  at least one of the compounds listed in FIG. 11.

3. The method of claim 1, wherein the degradative enzyme mixture in the treating step is provided in dry form, in a buffer, or in the form of a paste, paint, or micelle.

4. The method of claim 1, wherein the degradative enzyme mixture in the treating step is in a system comprising cellase, pectinase, and hemicellulase.

5. The method of claim 1, wherein the degradative enzyme mixture in the treating step is present in a system further comprising metal ions, chelators, detergents, organic ions, inorganic ions, or one or more additional proteins.

6. The method of claim 5, where the one or more additional proteins are biotin and/or albumin.

7. The method of claim 1, wherein the treating is conducted in a marine environment.

8. The method of claim 7, wherein the treating is conducted under water.

9. The method of claim 4, wherein the degradative enzyme mixture comprises cellulase Cel5F having SEQ ID NO: 13.

10. The method of claim 4, wherein the degradative enzyme mixture comprises cellulase cel5H having SEQ ID NO: 17.

11. The method of claim 4, wherein the degradative enzyme mixture comprises cellulase Cel5I having SEQ ID NO: 19.

12. The method of claim 1, further comprising contacting the saccharides with an ethanologenic microorganism to produce ethanol from the lignocellulosic material.

* * * * *